US012692487B2

(12) United States Patent (10) Patent No.: US 12,692,487 B2
Thomas et al. (45) Date of Patent: *Jul. 28, 2026

(54) ENZYMES WITH RUVC DOMAINS

(71) Applicant: METAGENOMI, INC., Emeryville, CA (US)

(72) Inventors: Brian C. Thomas, Berkeley, CA (US); Christopher Brown, Albany, CA (US); Rose Kantor, San Mateo, CA (US); Audra Devoto, Berkeley, CA (US); Cristina Butterfield, Oakland, CA (US); Lisa Alexander, Albany, CA (US); Daniela S.A. Goltsman, Oakland, CA (US); Jason Liu, Oakland, CA (US)

(73) Assignee: Metagenomi Therapeutics, Inc., Emeryville, CA (US)

( * ) Notice: Subject to any disclaimer, the term of this patent is extended or adjusted under 35 U.S.C. 154(b) by 46 days.

This patent is subject to a terminal disclaimer.

(21) Appl. No.: 18/668,543

(22) Filed: May 20, 2024

(65) Prior Publication Data

US 2024/0344045 A1 Oct. 17, 2024

Related U.S. Application Data

(60) Division of application No. 17/193,173, filed on Mar. 5, 2021, now Pat. No. 12,024,727, which is a continuation of application No. 16/917,837, filed on Jun. 30, 2020, now Pat. No. 10,982,200, which is a continuation-in-part of application No. PCT/US2020/018432, filed on Feb. 14, 2020.

(60) Provisional application No. 62/874,414, filed on Jul. 15, 2019, provisional application No. 62/805,878, filed on Feb. 14, 2019, provisional application No. 62/805,868, filed on Feb. 14, 2019, provisional application No. 62/805,899, filed on Feb. 14, 2019, provisional application No. 63/022,320, filed on May 8, 2020.

(51) Int. Cl.
*C12N 9/22* (2006.01)
*C12N 15/11* (2006.01)
*C12N 15/113* (2010.01)

(52) U.S. Cl.
CPC .............. *C12N 9/22* (2013.01); *C12N 15/11* (2013.01); *C12N 15/113* (2013.01); *C12N 2310/20* (2017.05); *C12N 2310/531* (2013.01); *C12N 2800/80* (2013.01)

(58) Field of Classification Search
CPC ........ C12N 9/22; C12N 15/11; C12N 15/113; C12N 2310/20; C12N 2310/531; C12N 2800/80; C12N 15/111
See application file for complete search history.

(56) References Cited

U.S. PATENT DOCUMENTS

| | | | |
|---|---|---|---|
| 5,858,988 A | 1/1999 | Wang | |
| 6,291,438 B1 | 9/2001 | Wang | |
| 8,889,418 B2 | 11/2014 | Zhang et al. | |
| 10,011,849 B1 | 7/2018 | Gill et al. | |
| 10,253,365 B1 | 4/2019 | Doudna et al. | |
| 10,392,607 B2 | 8/2019 | Sternberg et al. | |
| 10,913,941 B2 * | 2/2021 | Thomas | C12N 15/113 |
| 10,982,200 B2 | 4/2021 | Thomas et al. | |
| 11,946,039 B2 | 4/2024 | Thomas et al. | |
| 12,024,727 B2 * | 7/2024 | Thomas | C12N 15/113 |
| 2014/0186919 A1 | 7/2014 | Zhang et al. | |
| 2014/0186958 A1 | 7/2014 | Zhang et al. | |
| 2014/0349405 A1 | 11/2014 | Sontheimer et al. | |
| 2015/0045546 A1 | 2/2015 | Siksnys et al. | |
| 2016/0289700 A1 | 10/2016 | Barrangou et al. | |
| 2016/0362667 A1 | 12/2016 | Donohoue et al. | |
| 2018/0312824 A1 | 11/2018 | Zhang et al. | |
| 2018/0371498 A1 | 12/2018 | Gill et al. | |
| 2019/0010471 A1 | 1/2019 | Zhang et al. | |
| 2019/0062735 A1 | 2/2019 | Welstead et al. | |
| 2019/0249200 A1 | 8/2019 | Seebeck et al. | |
| 2019/0264232 A1 | 8/2019 | Hou et al. | |
| 2020/0032240 A1 | 1/2020 | Wang et al. | |
| 2020/0080067 A1 | 3/2020 | Zhang et al. | |
| 2020/0263165 A1 | 8/2020 | Bendezu et al. | |
| 2020/0302240 A1 | 9/2020 | Murata et al. | |
| 2020/0332273 A1 | 10/2020 | Thomas et al. | |
| 2020/0332274 A1 | 10/2020 | Thomas et al. | |
| 2022/0033791 A1 | 2/2022 | Thomas et al. | |
| 2022/0220460 A1 | 7/2022 | Thomas et al. | |
| 2022/0298494 A1 | 9/2022 | Thomas et al. | |
| 2022/0364067 A1 | 11/2022 | Lin et al. | |
| 2022/0403357 A1 | 12/2022 | Zhang et al. | |

(Continued)

FOREIGN PATENT DOCUMENTS

| | | |
|---|---|---|
| CA | 3091267 A1 | 8/2019 |
| CN | 104520429 A | 4/2015 |

(Continued)

OTHER PUBLICATIONS

Altae-Tran et al.: The widespread IS200/IS605 transposon family encodes diverse programmable RNA-guided endonucleases. Science. 374(6563):57-65 doi:10.1126/science.abj6856 (2021).

(Continued)

*Primary Examiner* — Ganapathirama Raghu

(74) *Attorney, Agent, or Firm* — Levine Bagade Han LLP

(57) ABSTRACT

The present disclosure provides for endonuclease enzymes having distinguishing domain features, as well as methods of using such enzymes or variants thereof.

20 Claims, 103 Drawing Sheets

Specification includes a Sequence Listing.

(56) References Cited

U.S. PATENT DOCUMENTS

| | | | |
|---|---|---|---|
| 2023/0051396 A1 | 2/2023 | Thomas et al. | |
| 2024/0110167 A1 | 4/2024 | Thomas et al. | |
| 2024/0117330 A1 | 4/2024 | Thomas et al. | |
| 2024/0209332 A1* | 6/2024 | Thomas ............... | C12N 15/102 |
| 2024/0309356 A1 | 9/2024 | Thomas et al. | |

FOREIGN PATENT DOCUMENTS

| | | |
|---|---|---|
| CN | 105142669 A | 12/2015 |
| CN | 105209621 A | 12/2015 |
| CN | 112126661 A | 12/2020 |
| EP | 3141604 A1 | 3/2017 |
| EP | 3617311 A1 | 3/2020 |
| EP | 3854877 A1 | 7/2021 |
| EP | 4308699 A1 | 1/2024 |
| JP | 2019507599 A | 3/2019 |
| JP | 2019534695 A | 12/2019 |
| JP | 2022520428 A | 3/2022 |
| WO | WO-2015066119 A1 | 5/2015 |
| WO | WO-2016073990 A2 | 5/2016 |
| WO | WO-2016141224 A1 | 9/2016 |
| WO | WO-2016183041 A2 | 11/2016 |
| WO | WO-2016186953 A1 | 11/2016 |
| WO | WO-2016196655 A1 | 12/2016 |
| WO | WO-2017152015 A1 | 9/2017 |
| WO | WO-2017155714 A1 | 9/2017 |
| WO | WO 2017/193107 | 11/2017 |
| WO | WO-2018035250 A1 | 2/2018 |
| WO | WO-2018041120 A1 | 3/2018 |
| WO | WO-2018064352 A1 | 4/2018 |
| WO | WO-2018073393 A2 | 4/2018 |
| WO | WO-2018129346 A1 | 7/2018 |
| WO | WO-2018172556 A1 | 9/2018 |
| WO | WO-2018209712 A1 | 11/2018 |
| WO | WO-2019097305 A2 | 5/2019 |
| WO | WO 2019/165168 | 8/2019 |
| WO | WO-2019161290 A1 | 8/2019 |
| WO | WO-2019178421 A1 | 9/2019 |
| WO | WO-2019200306 A1 | 10/2019 |
| WO | WO-2020041120 A1 | 2/2020 |
| WO | WO-2020057486 A1 | 3/2020 |
| WO | WO-2020081613 A1 | 4/2020 |
| WO | WO-2020150534 A2 | 7/2020 |
| WO | WO-2020168122 A1 | 8/2020 |
| WO | WO-2020168234 A1 | 8/2020 |
| WO | WO-2020168291 A1 | 8/2020 |
| WO | WO-2020236967 A1 | 11/2020 |
| WO | WO-2021097118 A1 | 5/2021 |
| WO | WO-2021202559 A1 | 10/2021 |
| WO | WO-2021202568 A1 | 10/2021 |
| WO | WO-2021226363 A1 | 11/2021 |
| WO | WO-2021226369 A1 | 11/2021 |
| WO | WO-2022056324 A1 | 3/2022 |
| WO | WO-2022087494 A1 | 4/2022 |

OTHER PUBLICATIONS

Andronescu et al. Efficient Parameter Estimation for RNA Secondary Structure Prediction. Bioinformatics 23(13):i19-28 (2007).

Bitard-Feildel, T. et al., Order in Disorder as Observed by the Hydrophobic Cluster Analysis of Protein Sequences, Proteomics, 2018, vol. 18, E1800054, pp. 1-12.

Burstein, David et al. New CRISPR-Cas systems from Uncultivated Microbes. Nature 542(7640):237-241 (2017).

Carugo, O., Amino Acid Composition and Protein Dimension, Protein Science, Oct. 2008, vol. 17, No. 12, pp. 2187-2191.

Corley , et al. How RNA-Binding Proteins Interact with RNA: Molecules and Mechanisms. Molecular Cell. 78(1):9-29 (2020).

CtSKENNERTON: Mining CRISPRs in Environmental Datasets: Minced. GitHub URL:www.github.com/ctSkennerton/minced [1-4](2019).

Ding et al.: Recent Advances in Genome Editing Using CRISPR/Cas9. Front Plant Sci. 7:703:1-12 doi:10.3389/fpls.2016.00703 (2016).

Dyson, H.J., Roles of intrinsic disorder in protein-nucleic acid interactions, Mol Biosyst, 2011, vol. 8, No. 1, pp. 97-104.

Fang et al.: CRISPR/Cas9-mediated Genome Editing Technology. Progress in Biochemistry and Biophysics, 40(8):691-702 [with English Machine Translation] (2013).

Gasiunas et al., A catalogue of biochemically diverse CRISPR-Cas9 orthologs. Nat Commun. 11: 5512, pp. 1-10 (2020).

Gasiunas, Giedrius. et al. Cas9-crRNA Ribonucleoprotein complex Mediates specific DNA cleavage for Adaptive Immunity in Bacteria. Proceedings of the National Academy of Sciences of the United States of America 109(39):E2579-E2586 (2012).

GenPept Accession No. CAH11307. Version No. CAH11307.1. hypothetical protein Ipp0160 [Legionella pneumophila str. Paris]. Record created Oct. 3, 2004. pp. 1-2. Retrieved Jun. 10, 2024 at URL: https://www.ncbi.nlm.nih.gov/protein/CAH11307.1.

GenPept Accession No. WP_127108862. Version No. WP_127108862.1. type II-B CRISPR-associated RNA-guided endonuclease Cas9/Csx12 [Legionella sp. km535]. Record created Jan. 6, 2019. pp. 1-2. Retrieved Jun. 10, 2024 at URL: https://www.ncbi.nlm.nih.gov/protein/WP_127108862.1.

Guo et al.: Off-target effects and optimization strategies of CRISPR/Cas9 technology. Progress in Biochemistry and Biophysics, 45(8):798-807 [with English Machine Translation] (2018).

Harms, M. et al., Analyzing protein structure and function using ancestral gene reconstruction, Current Opinion in Structural Biology, 2010, vol. 20, No. 6, pp. 360-366.

Harrington, Lucas B. et al. Programmed DNA Destruction by Miniature CRISPR-Cas14 Enzymes. Science 362(6416):839-842 (2018).

Harris, K.A. et al., Large Noncoding RNAs in Bacteria, Microbiol Spectr, 2018, vol. 6, No. 4, pp. 1-18.

Herdewijn: Heterocyclic modifications of oligonucleotides and antisense technology. Antisense & Nucleic Acid Drug Dev 10:297-310 (2000).

Huber et al. Orchestrating High-Throughput Genomic Analysis With Bioconductor. Nat Methods 12(2):115-21 (2015).

Jiang, F., et al., CRISPR—Cas9 Structures and Mechanisms, Annual Reviews Biophys., (2017), 46:505-529.

Jinek, Martin. et al. A Programmable dual-RNA-guided DNA Endonuclease in adaptive Bacterial Immunity. Science 337(6096):816-821 (2012).

Kapitonov et al.: ISC, a Novel Group of Bacterial and Archaeal DNA Transposons That Encode Cas9 Homologs. J Bacteriol. 198(5):797-807 doi:10.1128/JB.00783-15 (2015).

Karvelis et al. Methods for Decoding Cas9 Protospacer Adjacent Motif (PAM) Sequences: A Brief Overview. Methods 121-122:3-8 (2017).

Katoh, K. et al., "MAFFT Multiple Sequence Alignment Software Version 7: Improvements in Performance and Usability", Molecular Biology and Evolution, 2013, vol. 30, No. 4, pp. 772-780.

Koonin et al. (2017) Diversity, classification and evolution of CRISPR-Cas systems. Current Opinion in Microbiology, 37:67-78 (Year : 2017).

Kortleve, D. et al. Orthotopic editing of T-cell receptors. Cell Therapy vol. 3: 949-950 (2019).

Madshus, I.H .. Regulation of intracellular pH in eukaryotic cells, Biochemical Journal, 1988, vol. 250, No. 1, pp. 1-8.

Makarova et al. Evolutionary classification of CRISPR-Cas systems: a burst of class 2 and derived variants. Nat Rev Microbiol. 18(2):67-83 (2020).

Mali, Prashant et al. RNA-Guided Human Genome Engineering via Cas9. Science 339(6121):823-826 (2013).

Mir et al.: Type II-C CRISPR-Cas9 Biology, Mechanism, and Application. ACS Chem Biol. 13(2):357-365 (2018).

Moon et al.: Recent advances in the CRISPR genome editing tool set. Exp Mol Med. 51(130):1-11 (2019).

Murthy, A.C. et al., Molecular interactions underlying liquid-liquid phase separation of the FUS low complexity domain, Nat Struct Mol Biol, 2019, vol. 26, No. 7, pp. 637-648.

NCBI GenBank Accession No. HHR99113.1, TPA: type II CRISPR RNA-guided endonuclease Cas9 [Acidobacteria bacterium] [1-2](2020).

NCBI GenBank Accession No. WP_061212298.1, HNH endonuclease [Dermabacter hominis] [1-2](2016).

(56) References Cited

OTHER PUBLICATIONS

NCBI GenBank: GBR72910.1—CRISPR-associated protein Csn1 family [Candidatus Termititenax aidoneus], pp. 1-3 (Oct. 31, 2019).
NCBI GenBank: OGP48943.1—MAG: hypothetical protein A2022_01700 [Deltaproteobacteria bacterium GWF2_42_12], pp. 1-2 (Oct. 20, 2016).
NCBI GenBank: WP_070675185.1—Multispecies: HNH endonuclease [unclassified Rothia (in: high G+C Gram-positive bacteria)], pp. 1-2 (Jan. 20, 2023).
NCBI GenBank: WP_070690139.1—HNH endonuclease [*Rothia* sp. HMSC076D04], pp. 1-3 (Jan. 20, 2023).
NCBI GenBank: WP_070847477.1—HNH endonuclease [*Rothia* sp. HMSC065C03], pp. 1-2 (May 16, 2022).
NCBI Reference Sequence: RMH36335.1, hypothetical protein D66910_06140 [Nitrospirae bacterium], https://www.ncbi.nlm.nih.gov/protein/RMH36335.1/ [1-2](Published on Oct. 29, 2018).
Nowak et al. Guide RNA engineering for versatile Cas9 functionality. Nucleic Acids Res. 44(20):9555-9564 (2016).
Osorio, D. et al., Peptides: A Package for Data Mining of Antimicrobial Peptides, The R. Journal, 2015, 7(1), 4-14, pp. 1-11.
Paix, et al. Precision genome editing using synthesis-dependent repair of Cas9-induced DNA breaks. Proceedings of the National Academy of Sciences of the United States of America 114,50:E10745-E10754 (2017).
PCT/US2020/018353 International Search Report and Written Opinion dated Jun. 30, 2020.
PCT/US2020/018432 International Search Report and Written Opinion dated Jun. 30, 2020.
PCT/US2021/024927 International Search Report and Written Opinion dated Jul. 21, 2021.
PCT/US2021/024945 International Search Report and Written Opinion mailed Jul. 20, 2021.
PCT/US2021/031136 International Search Report and Written Opinion dated Aug. 25, 2021.
PCT/US2021/031143 International Search Report and Written Opinion dated Aug. 25, 2021.
Price, M.N et al., Fast Tree2—Approximately Maximum-Likelihood Trees for Large Alignments, PLOS One, 2010, vol. 5, No. 3, e9490, pp. 1-10.
Ran, F. et al., In vivo genome editing using *Staphylococcus aureus* Cas 9, Nature, 2015, vol. 520, pp. 1-18.
Rautela et al.: Efficient genome editing of human natural killer cells by CRISPR RNP. bioRxiv prePrint doi: https://doi.org/10.1101/406934 [1-24] (2018).
Schneider et al. Sequence logos: a new way to display consensus sequences. Nucleic acids research 18(20):6097-6100 (1990).
Shmakov, Sergey. et al. Discovery and Functional Characterization of Diverse Class 2 CRISPR-Cas Systems. Molecular Cell 60(3):385-397 (2015).
Shmakov, Sergey. et al. Diversity and evolution of class 2 CRISPR-Cas systems. Nature Reviews Microbiology 15(3):169-182 (2017).
Singh, et al. Protein Engineering Approaches in the Post-Genomic Era. Current Protein and Peptide Science 18:1-11 (2017).
Stamatakis, A., RAxML Version 8: a tool for phylogenetic analysis and post-analysis of large phylogenies, Bioinformatics, 2014, vol. 30, No. 9, pp. 1312-1313.
Tang et al.: Class 2 CRISPR/Cas: an expanding biotechnology toolbox for and beyond genome editing. Cell Biosci. 8:59 doi:10.1186/s13578-018-0255-x [1-13](2018).
Tareen et al.: Logomaker: beautiful sequence logos in Python. Bioinformatics 6(7):2272-2274 (2020).
UniProtKB Accession No. A0A3B9GP868. CRISPR-associated endonuclease Cas9. Record created Jan. 16, 2019. p. 1, Retrieved Jun. 10, 2024 at URL: https://www.uniprot.org/uniprotkb/A0A3B9GP86/entry.
UniProtKB, [online] Accession No. A0A1F8ZSN4, HNH nuclease domain-containing protein, Dec. 11, 2019, p. 1 [retrieved online Apr. 24, 2024], URL: https://rest.uniprot.org/unisave/A0A1F8ZSN4?format=txt&versions=11.

UniProtKB, [online] Accession No. AA0A3D 5Y812 and HNHc domain-containingprotein, Dec. 11, 2019, p. 1 [retrieved online Apr. 24, 2024], URL: https://rest.uniprot.org/unisave/A0A3D5Y812?format=txt&versions=6.
Uniprotkb/trembl: A0A1F0KNW4 • A0A1F0KNW4_9MICC HNHc domain-containing protein. *Rothia* sp. HMSC066H02, pp. 1-5 [retrieved online Dec. 1, 2022] URL: https://www.uniprot.org/uniprotkb/A0A1F0KNW4/entry (Feb. 15, 2017).
Uniprotkb/trembl: A0A1S1DAD0 • A0A1S1DAD0_9MICC HNH Cas9-type domain-containing protein. *Rothia* sp. HMSC065C03, pp. 1-5 [retrieved online Dec. 1, 2022] URL: https://www.uniprot.org/uniprotkb/A0A1S1DAD0/entry (Apr. 12, 2017).
Uniprotkb/trembl: A1F0PN46 • A0A1F0PN46_9MICC HNH Cas9-type domain-containing protein. *Rothia* sp. HMSC076D04, pp. 1-5 [retrieved online Dec. 1, 2022] URL: https://www.uniprot.org/uniprotkb/A0A1F0PN46/entry (Feb. 15, 2017).
U.S. Appl. No. 17/193,173 Final Office Action dated Apr. 17, 2023.
U.S. Appl. No. 17/193,173 Non-Final Office Action dated Oct. 7, 2022.
U.S. Appl. No. 17/857,923 Advisory Action dated Aug. 8, 2023.
U.S. Appl. No. 17/857,923 Final Office Action dated Jun. 13, 2023.
U.S. Appl. No. 17/857,923 Non-Final Office Action dated Feb. 28, 2023.
U.S. Appl. No. 16/917,837 Office Action dated Aug. 26, 2020.
U.S. Appl. No. 16/917,838 Office Action dated Jul. 28, 2020.
U.S. Appl. No. 17/431,135 Office Action dated Jun. 4, 2024.
Weinberg, Z. et al., Extraordinary Structured Noncoding RNAs Revealed by Bacterial Metagenome Analysis, Nature 2009, vol. 462, No. 7273, pp. 656-659.
Xiao, N. et la., protr/ProtrWeb: R package and web server for generating various numerical representation schemes of protein sequences, Bioinformatics, 2015, vol. 31, No. 11, pp. 1857-1859.
Xu, Daohua. Tigit Cas9-KO Strategy. GenPharmatech Co, Ltd., Retrieved at URL: https://oss.gempharmatech.com/upload/file/20240324/T012735.Tigit%20Cas9-KO%20%20Strategy-EN.pdf, 11 pages (2019).
Xu, et al. Efficient genome engineering in eukaryotes using Cas9 from *Streptococcus thermophilus*. Cellular and Molecular Life Sciences 72(2):383-399 (2014).
Yan et al., Functionally diverse type V CRISPR-Cas systems. Science 363: 88-91 (2019).
Yang et al.: New CRISPR-Cas systems discovered. Cell Res. 27(3):313-314 doi:10.1038/cr.2017.21 (2017).
Yang, Z., PAML 4: Phylogenetic Analysis by Maximum Likelihood, Molecular Biology and Evolution, 2007, vol. 24, No. 8, pp. 1586-1591.
Zhang et al. Propagated Perturbations from a Peripheral Mutation Show Interactions Supporting WW Domain Thermostability. Structure 26(11):1474-1485 (2018).
Zhou, X.M. et al. Intrinsic Expression of Immune Checkpoint Molecule TIGIT Could Help Tumor Growth in vivo by Suppressing the Function of NK and CD8+ T Cells. Front. Immunol. vol. 9, Article 2821: 1-11 (2018).
Boel, A. et al., "CRISPR/Cas9-mediated homology-directed repair by ssODNs in zebrafish induces complex mutational patterns resulting from genomic integration of repair-template fragments", *Dis Model Mech.*, vol. 11(10), pp. 1-11, 2018.
Database Genbank [on line], Accession No. LTTT01000045.1, 2016 [retrieved on Jul. 25, 2025], hypothetical protein HMPREF2999_08435 [*Rothia* sp. HMSC066H02], <https://www.ncbi.nlm.nih.gov/protein/1080742115).
Gleditzsch, D. et al., "PAM identification by CRISPR-Cas effector complexes: diversified mechanisms and structures", *RNA Biol.*, vol. 16(4), pp. 504-517, 2019.
Leenay, R. et al., "Deciphering, Communicating, and Engineering the CRISPR PAM", *J Mol Biol.*, vol. 429(2), pp. 177-191, 2017.
Nishimasu, Hiroshi et al., "Crystal Structure of Cas9 in Complex with Guide RNA and Target DNA", Cell, vol. 156, Issue 5, p. 935-949, Feb. 27, 2014.
Parks, D. H. et al., "A standardized bacterial taxonomy based on genome phylogeny substantially revises the tree of life", Nature Biotechnology, vol. 36, p. 996-1004, Aug. 27, 2018.

(56) References Cited

OTHER PUBLICATIONS

Pingoud, A. et al., "Type II restriction endonucleases: structure and mechanism", *Cell Mol Life Sci.*, vol. 62(6), pp. 685-707, 2005.
Wu, X. et al., "Target specificity of the CRISPR-Cas9 system", *Quant Biol.*, vol. 2(2), pp. 59-70, 2014.

* cited by examiner

Cas9 programmed by crRNA:tracrRNA duplex
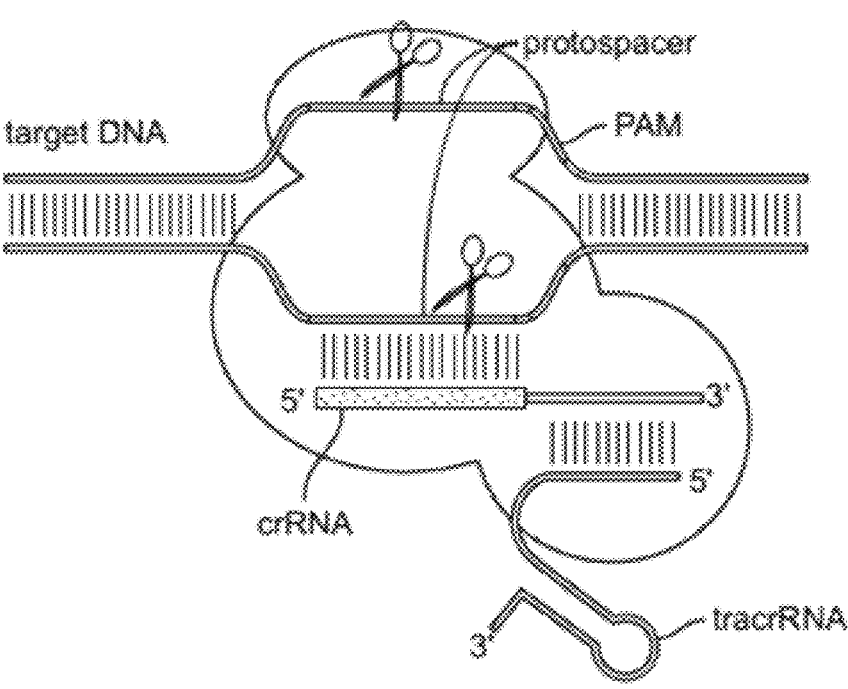
Cas9 programmed by single chimeric RNA
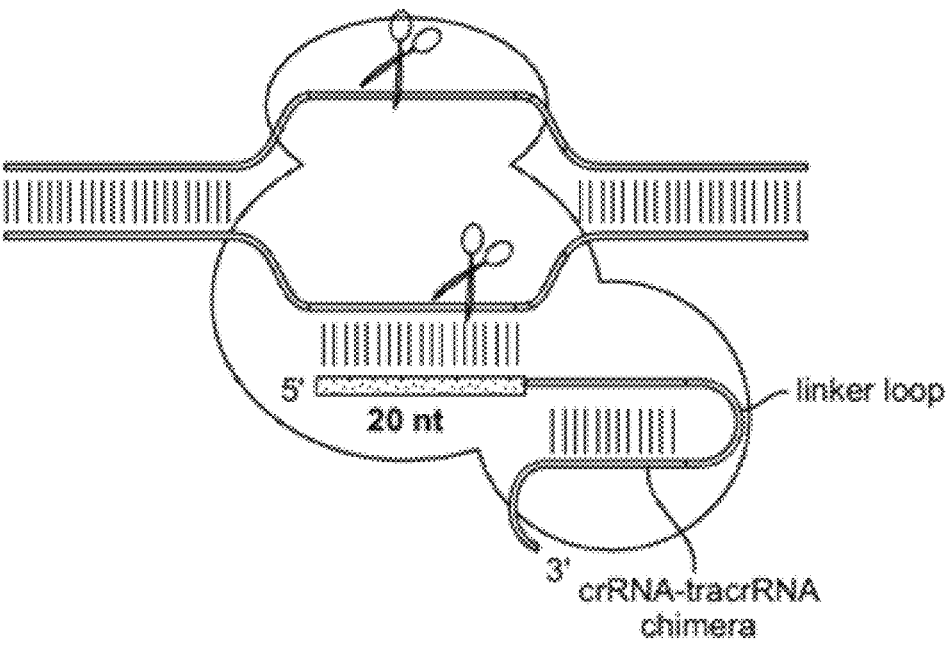
FIG. 2

```
                160         170        180        190        200
1. MG2-1     TD GAEPWGDELQDKEIIQWAKNSCCAPEYRTHLCNLIE
2. S_aureus_Cas9  EV EDTGNELS----------------------EADAAWAKNSDG
                              Recognition lobe 210         220        230        240        250
1. MG2-1     SFTEKYLKVRQALDDAVREYNRPVERMLEQHMSEKNHPHLRPRARGRN
2. S_aureus_Cas9  ----TKEQISRNSKALEEKYVAELQLERLKKDGEVRG----SINR
                              Recognition lobe 260         270        280        290        300
1. MG2-1     ARELVKQHLYALCEKHRHEFAPGTDQAMRELGDQTGPSQWKLTWMDQD
2. S_aureus_Cas9  KTSDVVKEAKQLLKVQKAYHQQSIDTYIDETRRTVYEGPGEGSPFG
                              Recognition lobe
```

FIG. 7A (Cont. 1)

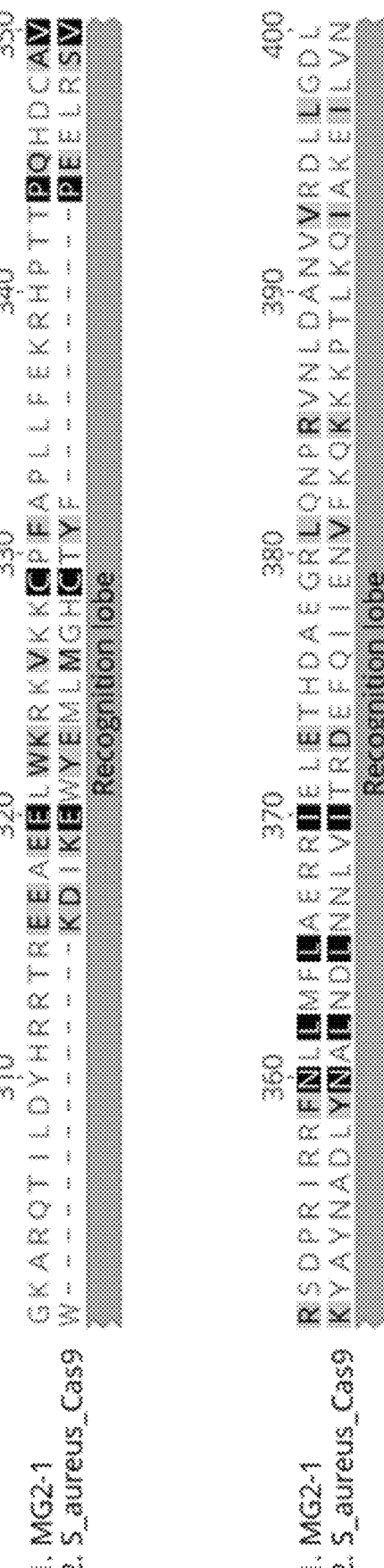
FIG. 7A (Cont. 2)

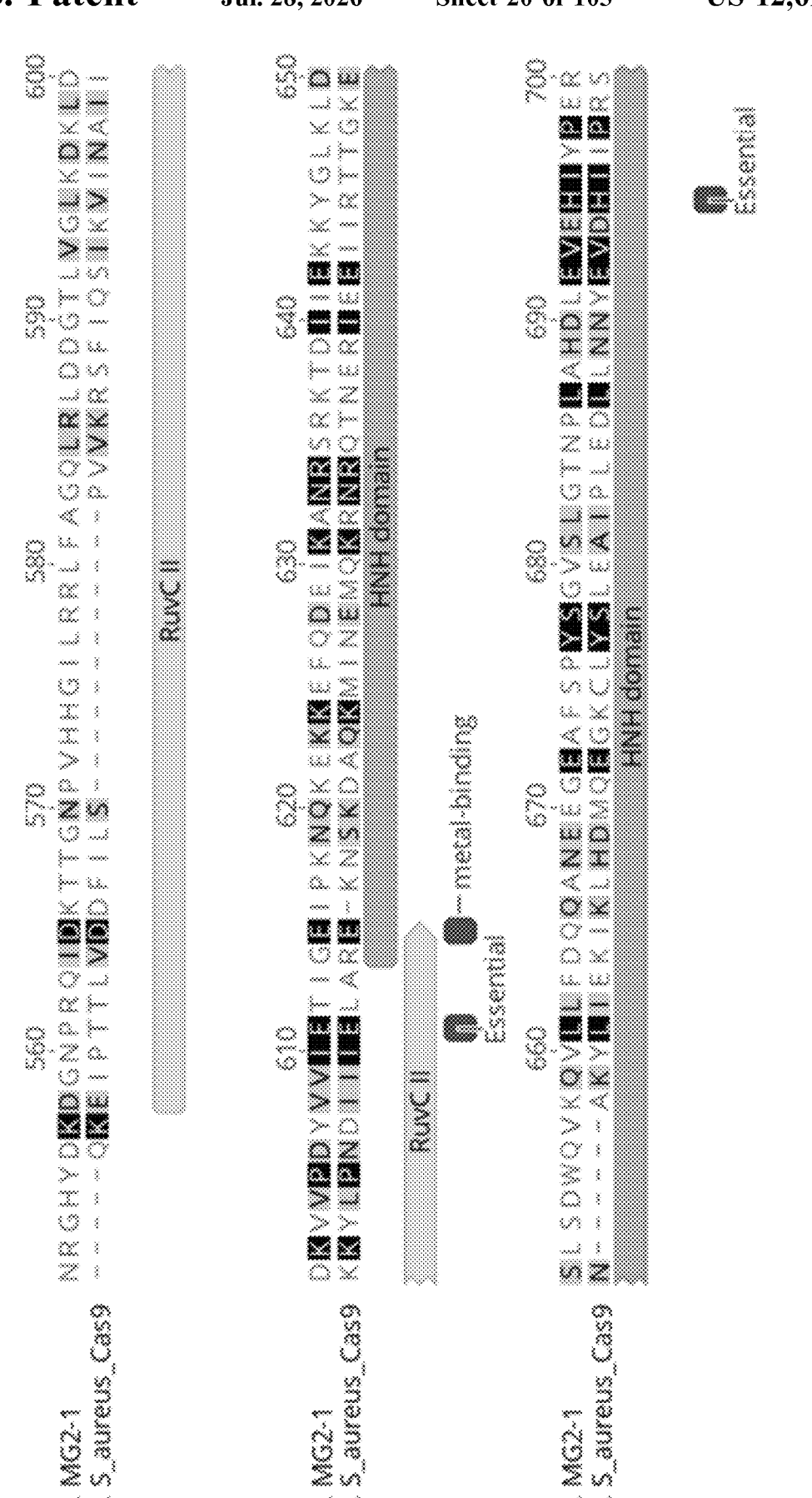
FIG. 7B (Cont. 1)

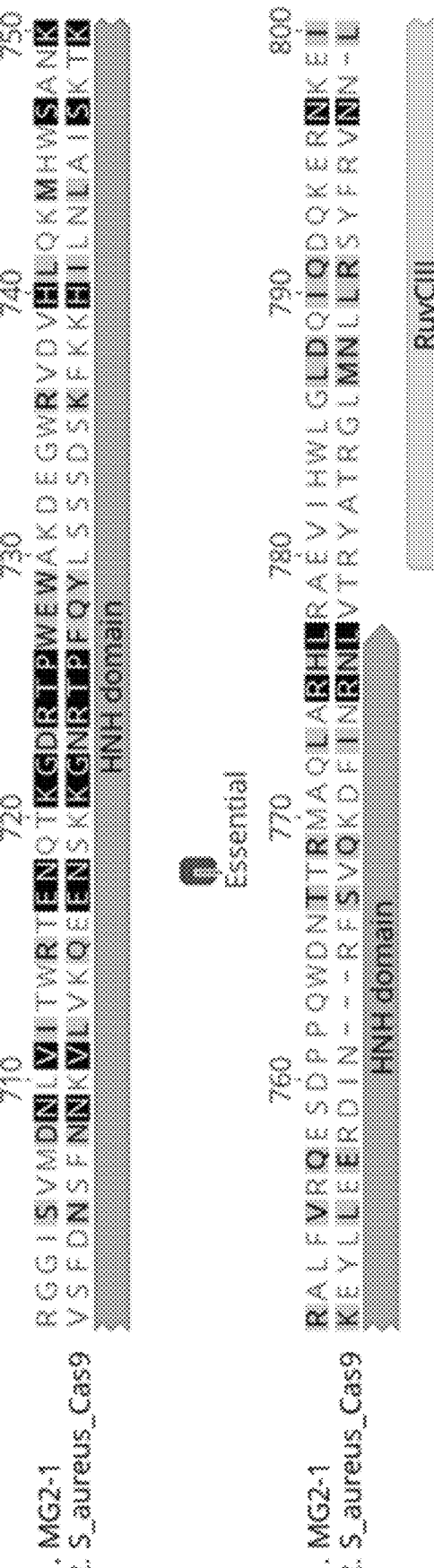
FIG. 7B (Cont. 2)

FIG. 8A

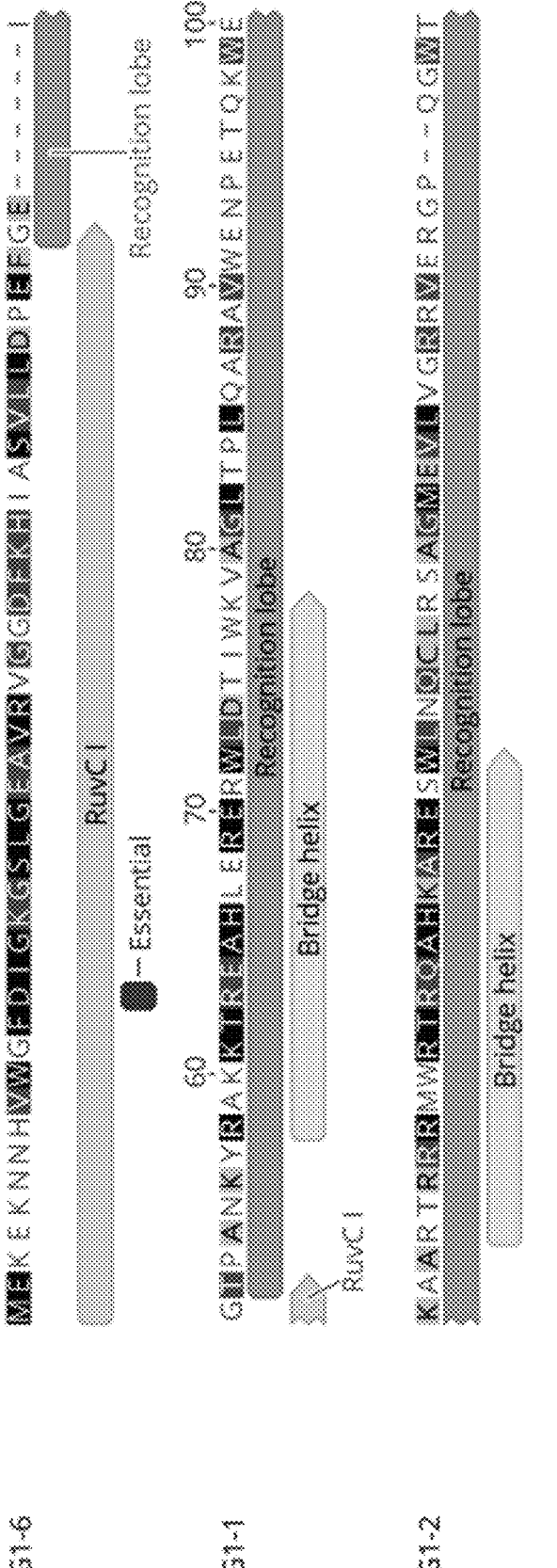
FIG. 9A (Cont. 1)

Recognition lobe

Bridge helix

Recognition lobe

Bridge helix

Recognition lobe

Bridge helix

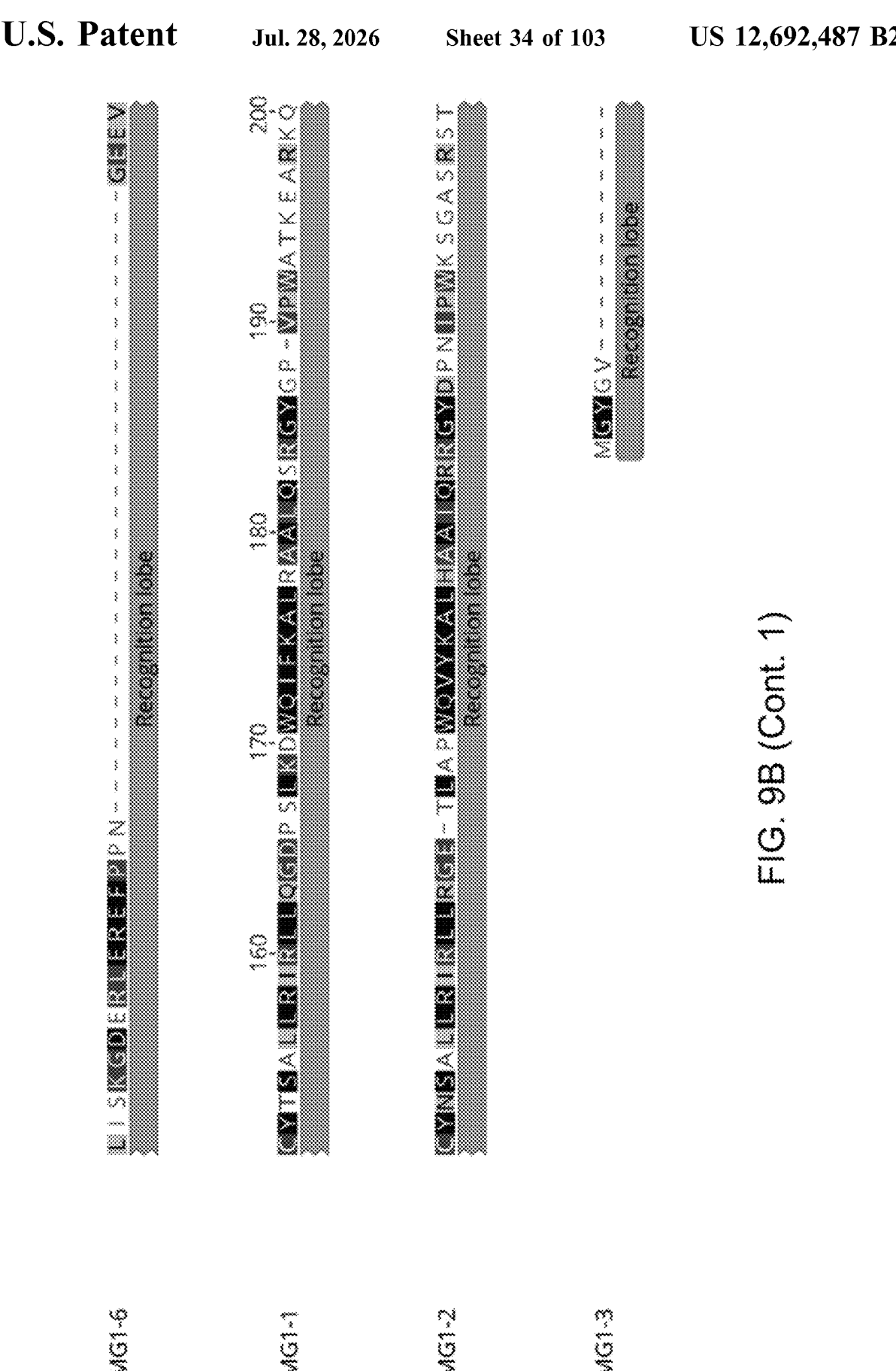
FIG. 9B (Cont. 1)

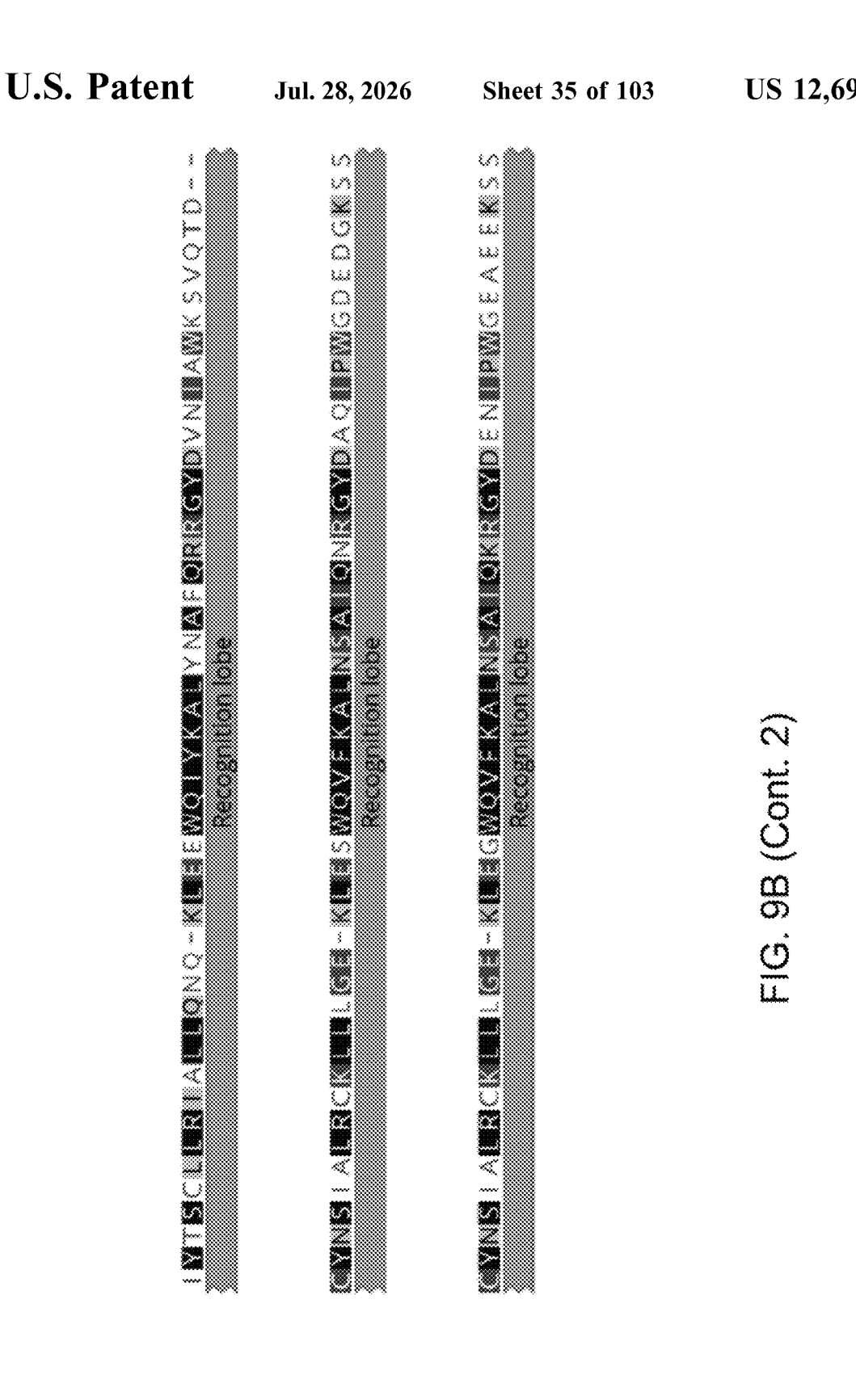
4. MG1-4
5. MG1-5
6. MG1-6
FIG. 9B (Cont. 2)

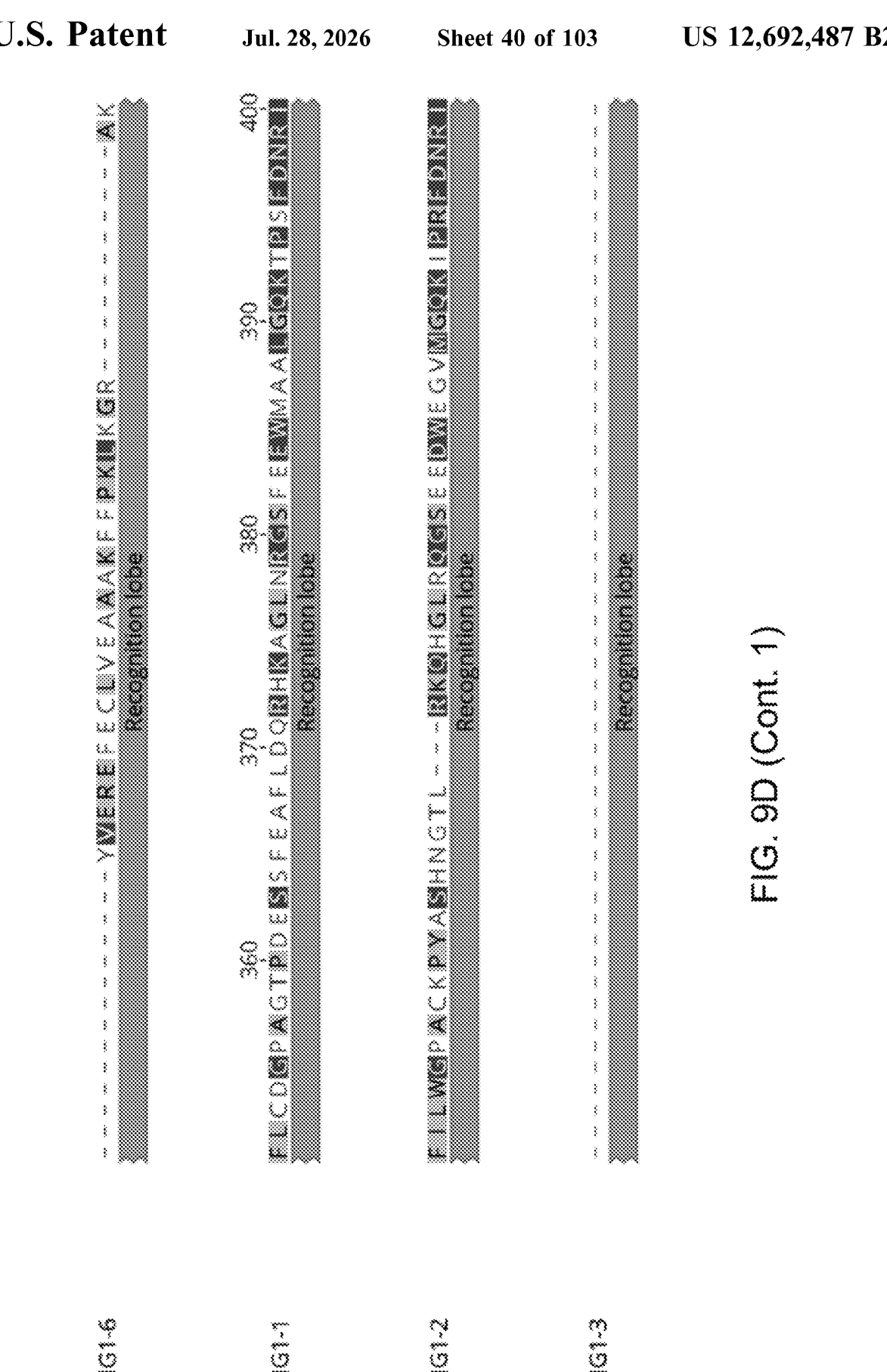
FIG. 9D (Cont. 1)

FIG. 9D (Cont. 2)

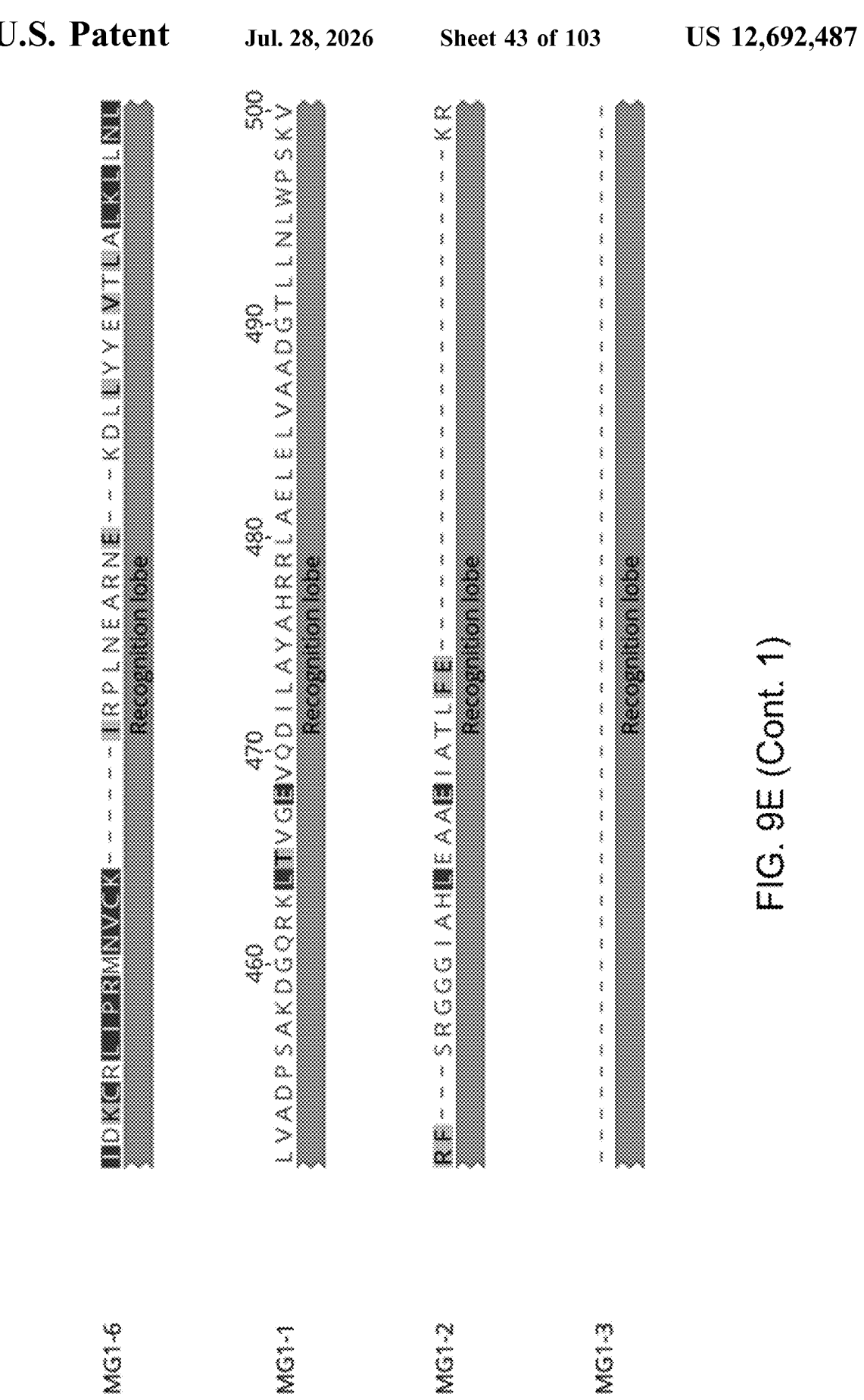
FIG. 9E (Cont. 1)

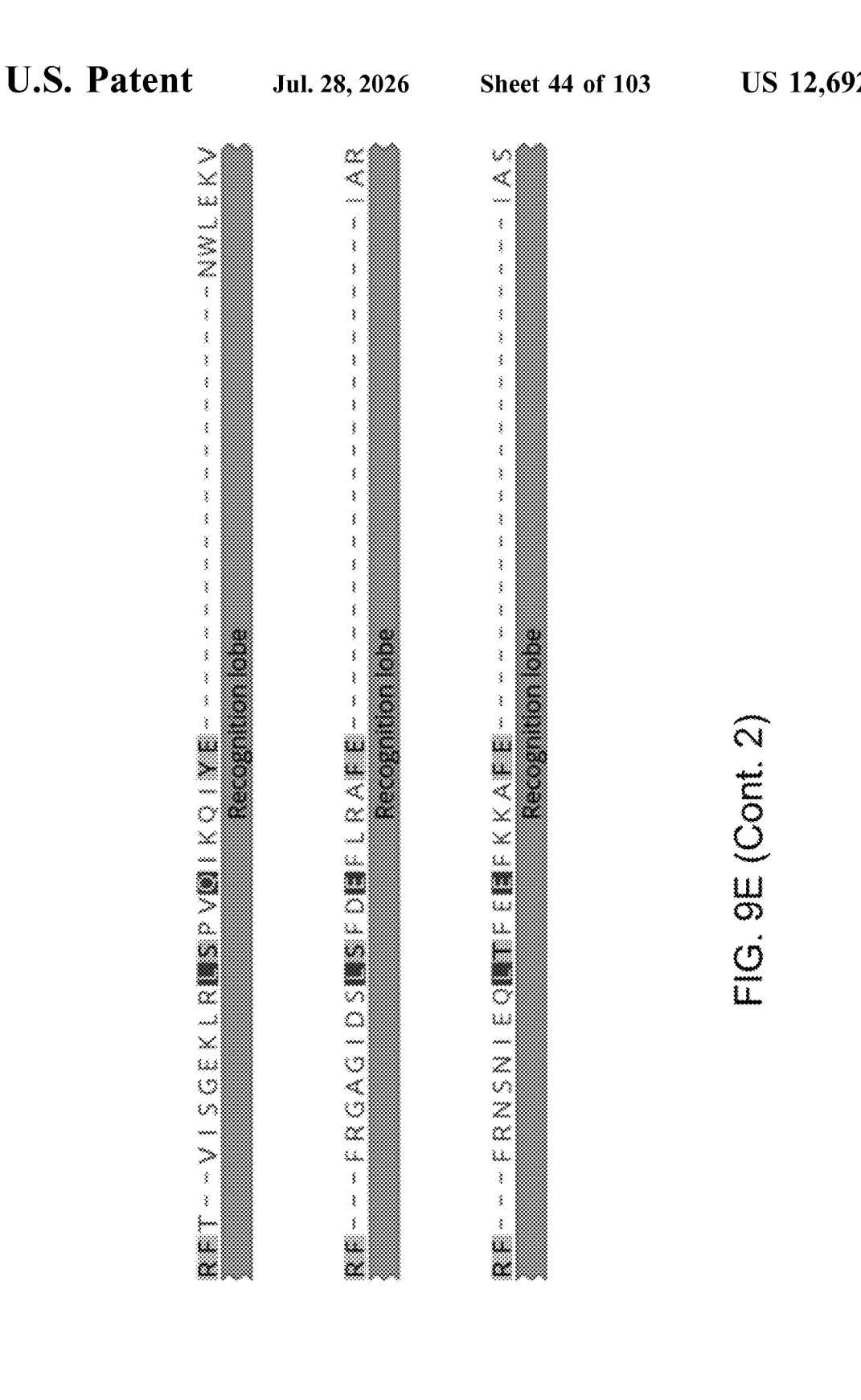
4. MG1-4
5. MG1-5
6. MG1-6
FIG. 9E (Cont. 2)

FIG. 9F 710   720   730   740   750

Figure 9H:
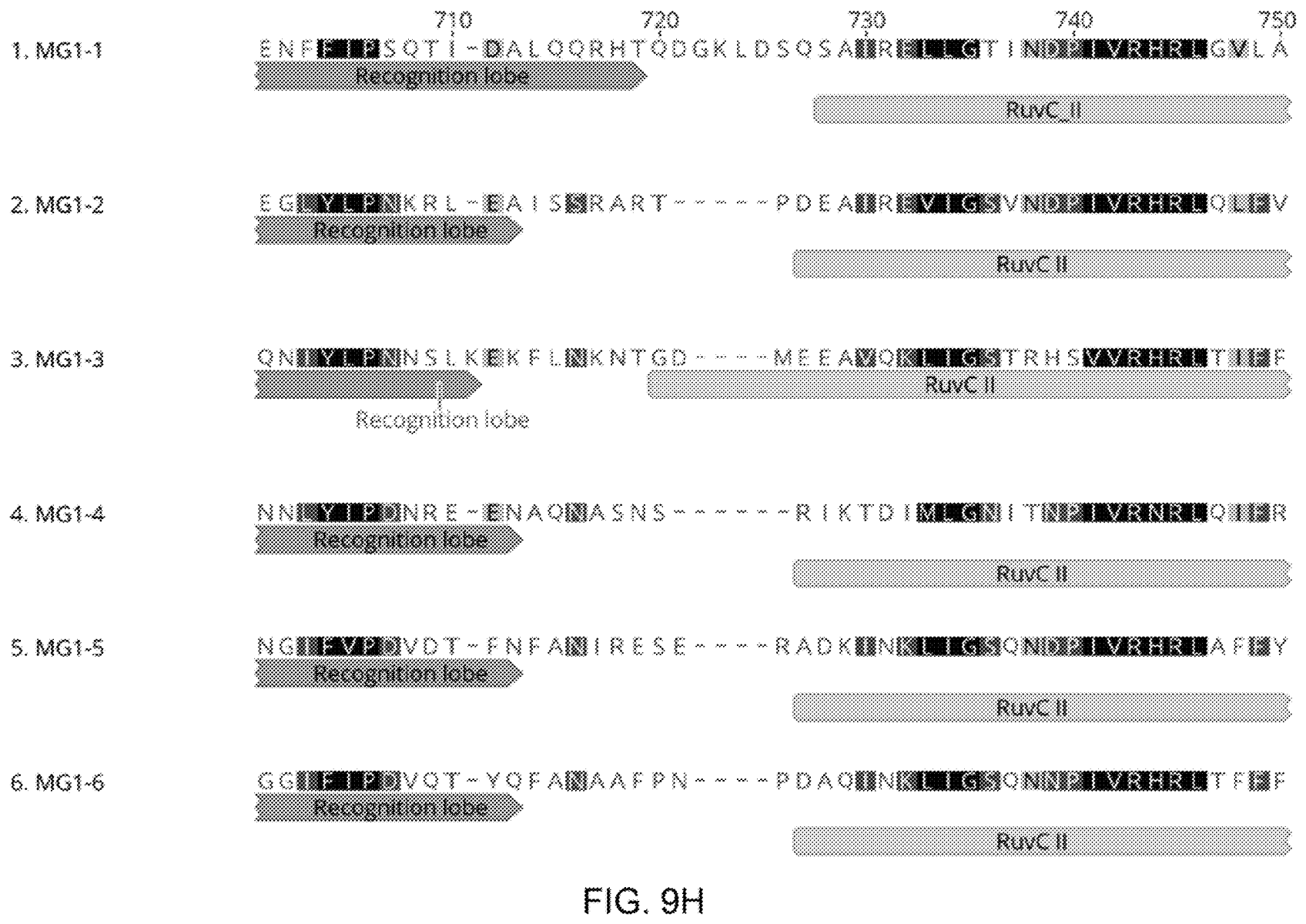

1. MG1-1   ENF___SQTI-DALQQRHTQDGKLDSQSA_R___GT I N__ VR_R_GWLA   Recognition lobe   RuvC II 2. MG1-2   EG_Y_N_RL-EA I S__RART-----PDEA_R_V_G_V_N__ VR_R_Q__V   Recognition lobe   RuvC II 3. MG1-3   QN_Y_NNSLKEKF L__KNTGD------MEEA_Q_L___TRHSVVR_R_T__F   Recognition lobe   RuvC II 4. MG1-4   NN_Y__NRE-ENAQ__ASNS------R I KTD I M_G_ I T___VR_R_Q__R   Recognition lobe   RuvC II 5. MG1-5   NG_F_P_VDT-FNFA__ I RESE----RADK_N_L_Q_N__ VR_R_AF__Y   Recognition lobe   RuvC II 6. MG1-6   GG_F_P_VDT-YQFA__AAFPN----PDAQ_N_L_Q_N__ VR_R_T F__F   Recognition lobe   RuvC II

Figure 9L:
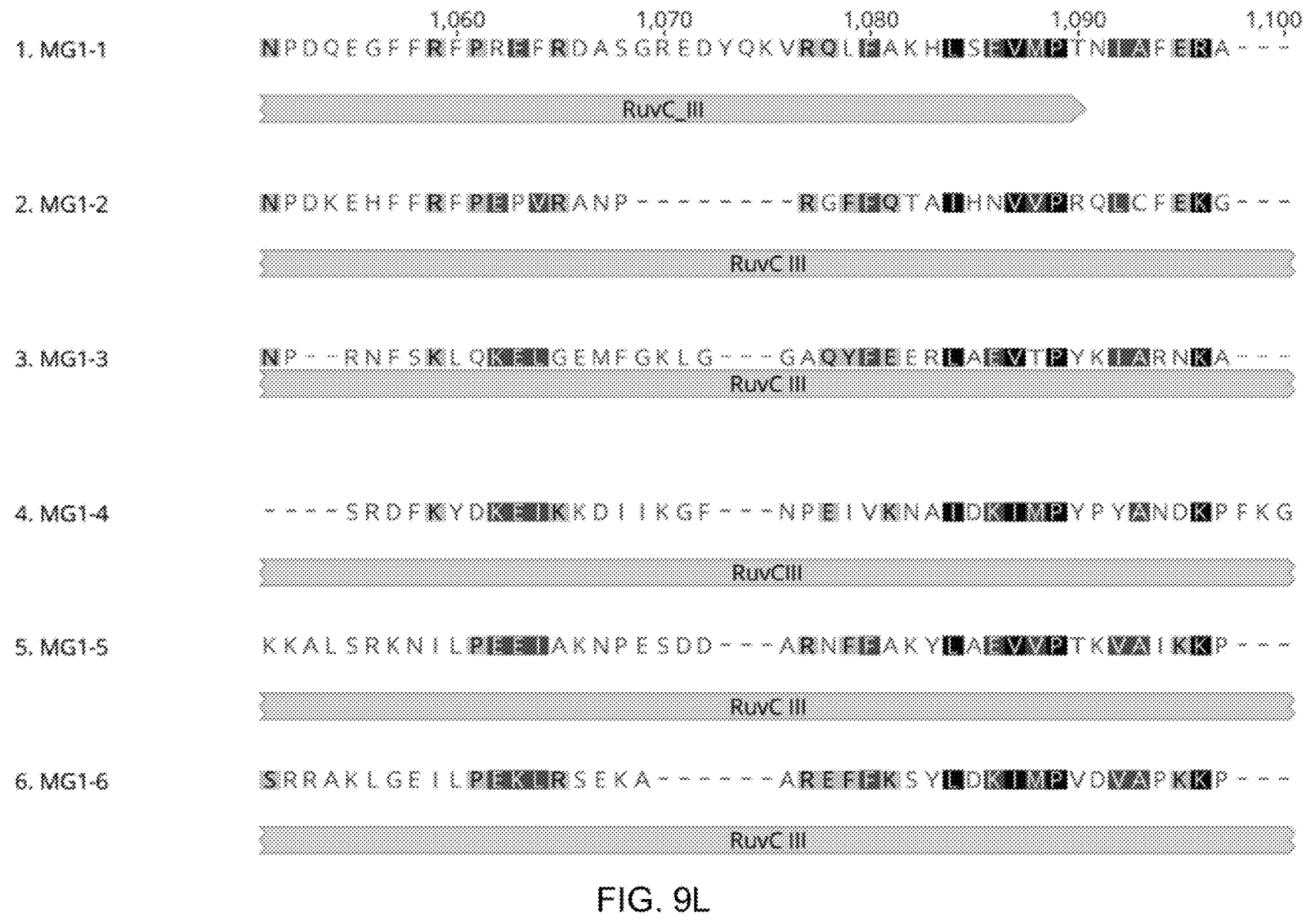

Figure 9L:
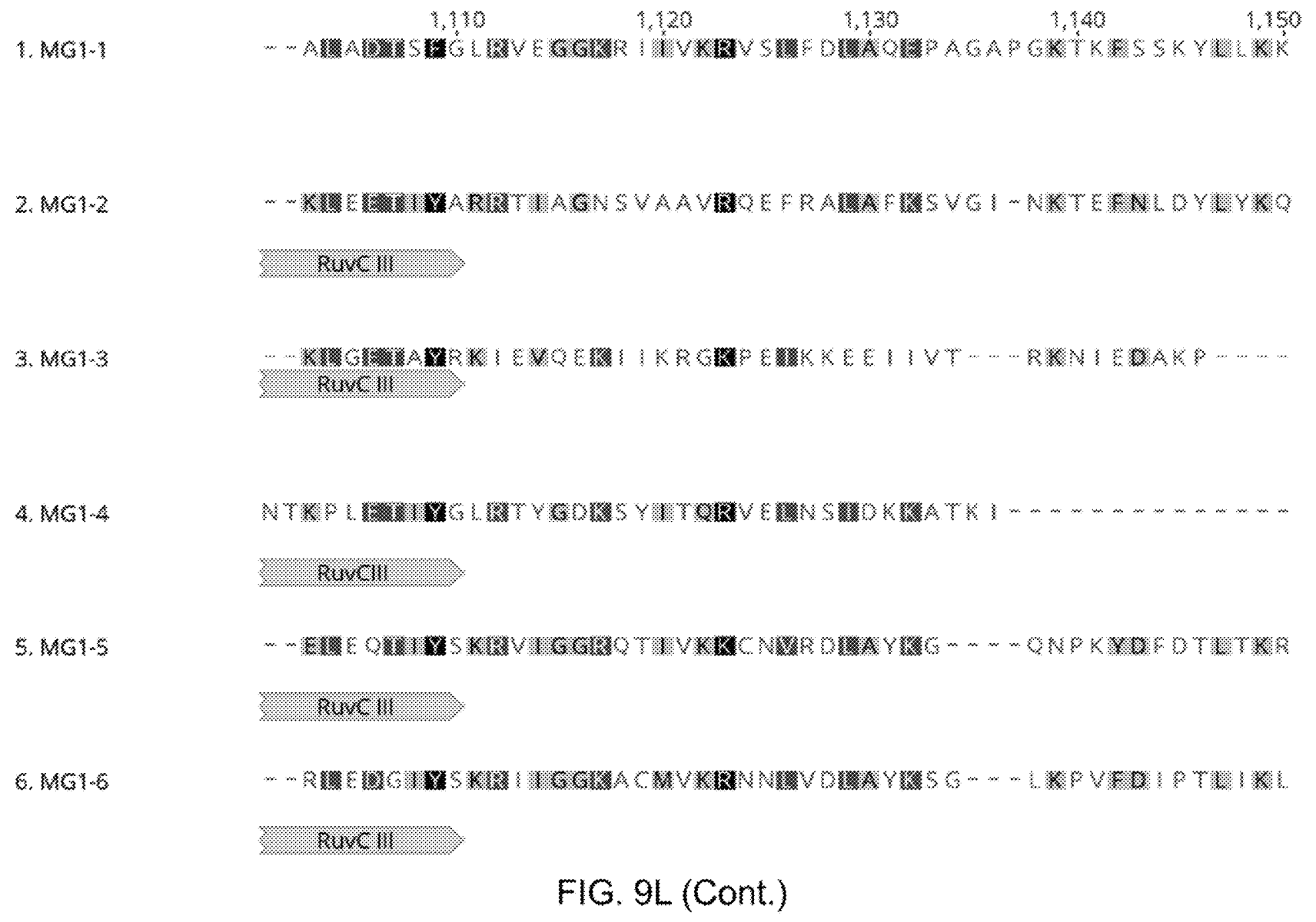

Figure 9N:
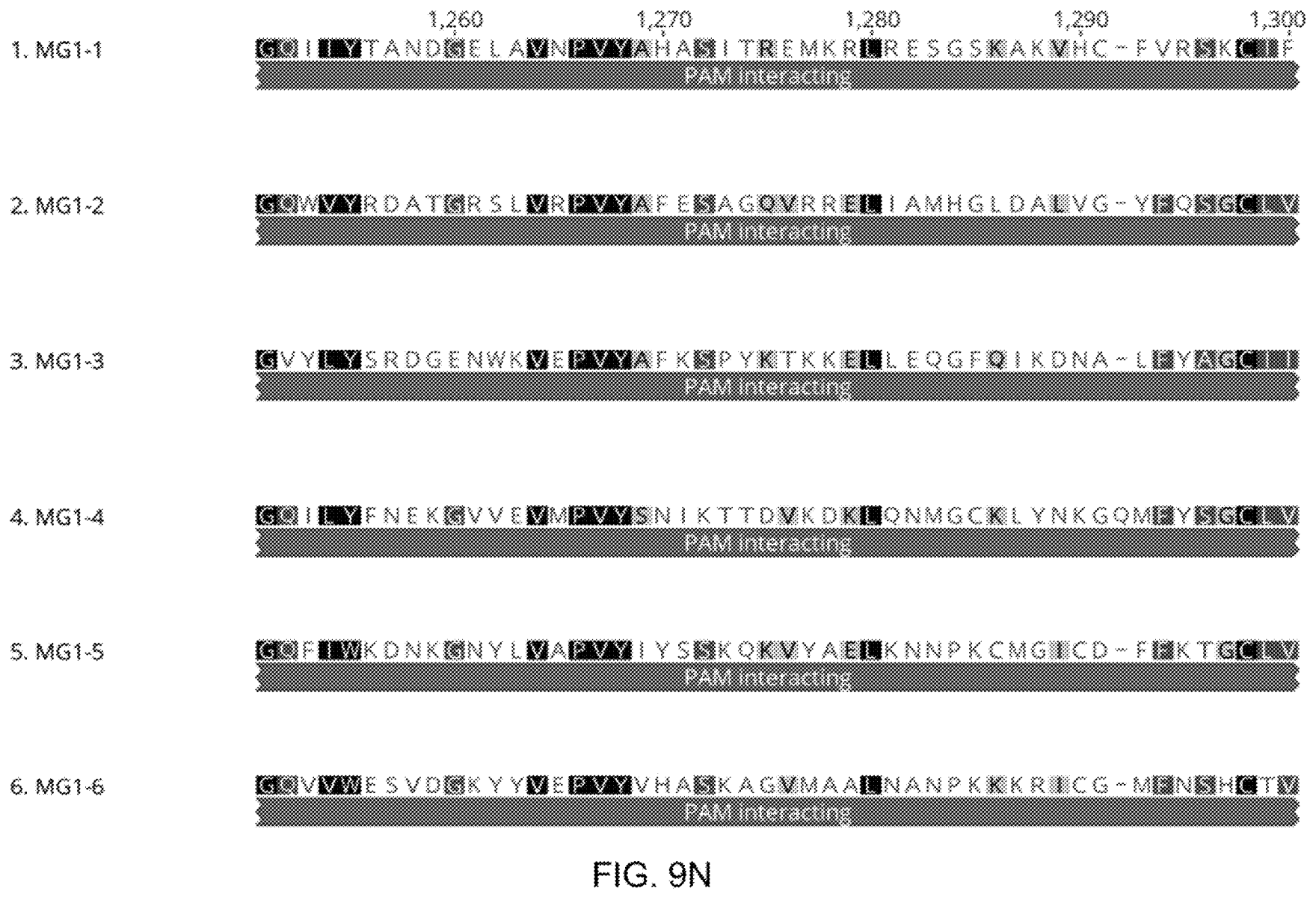

HRRKAMPQPEYKLVVKNEQKQKRRIPATLAMAPARMNMLITDSMDVEF
PAM interacting

2. MG1-2

EMVRPVAHKK------TPMAPDRSLNNRKDGFAVMT
PAM interacting

3. MG1-3

EMTENIEGKD------MDRCKMTAMKKTAGTIKIR
PAM interacting

4. MG1-4

DIPKPFKAGS------KEYPACRYQIKRSDKVAEIE
PAM interacting

5. MG1-5

KISNEVVDEK------KNRLWMKACFMNNSAKEKRVYMT
PAM interacting

6. MG1-6

DVGDVYNDRG------DFIMPAGRYMKNMLITGRCVMT
PAM interacting

FIG. 9N (Cont.)

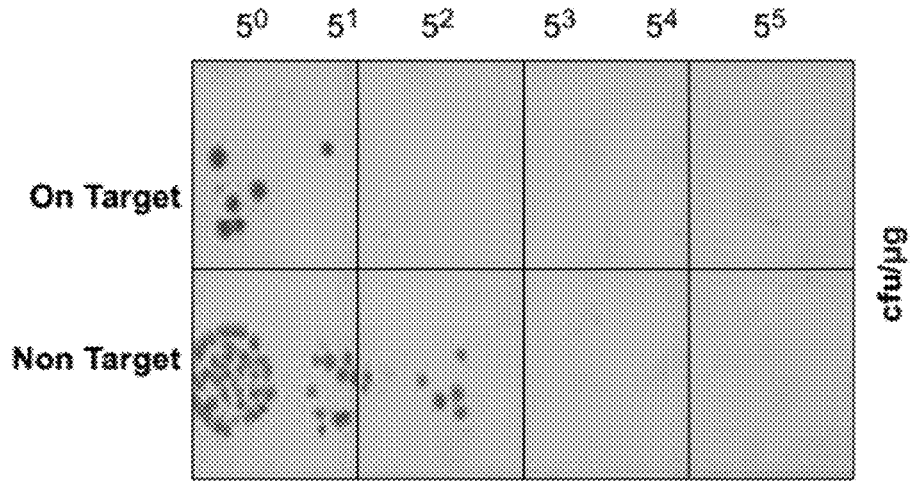
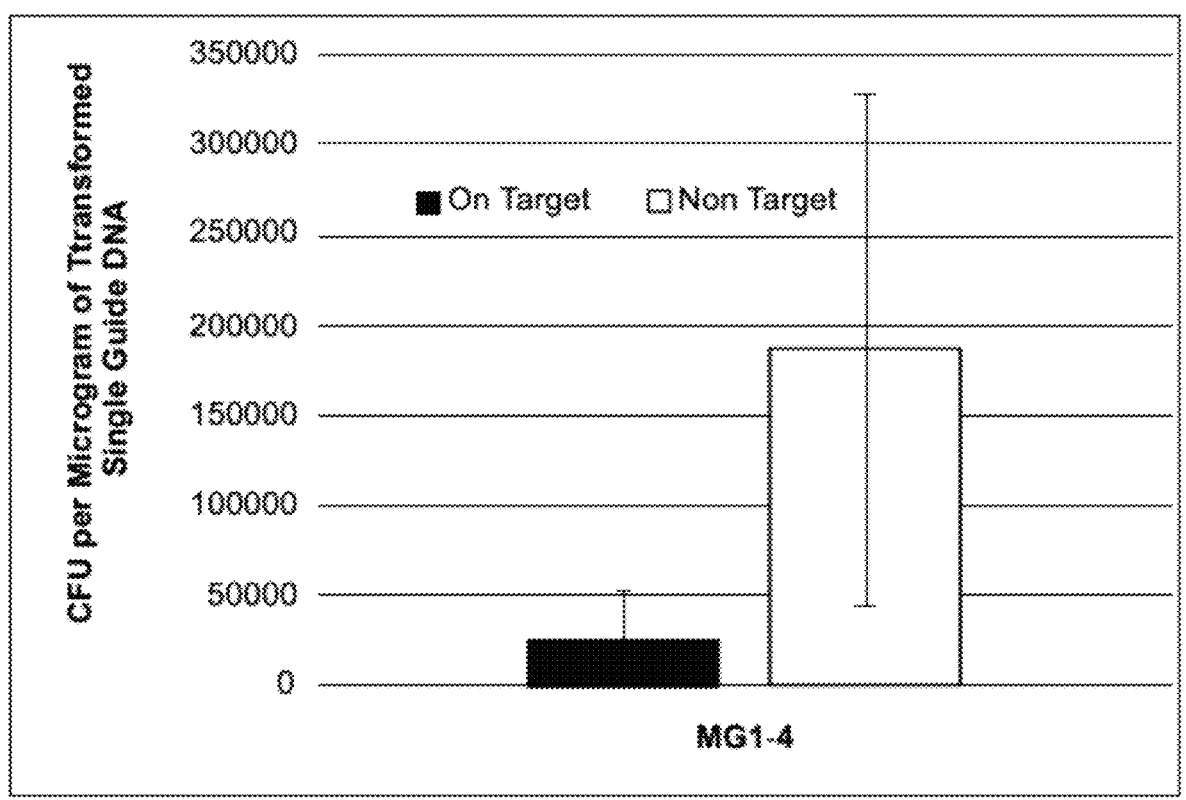
FIG. 11

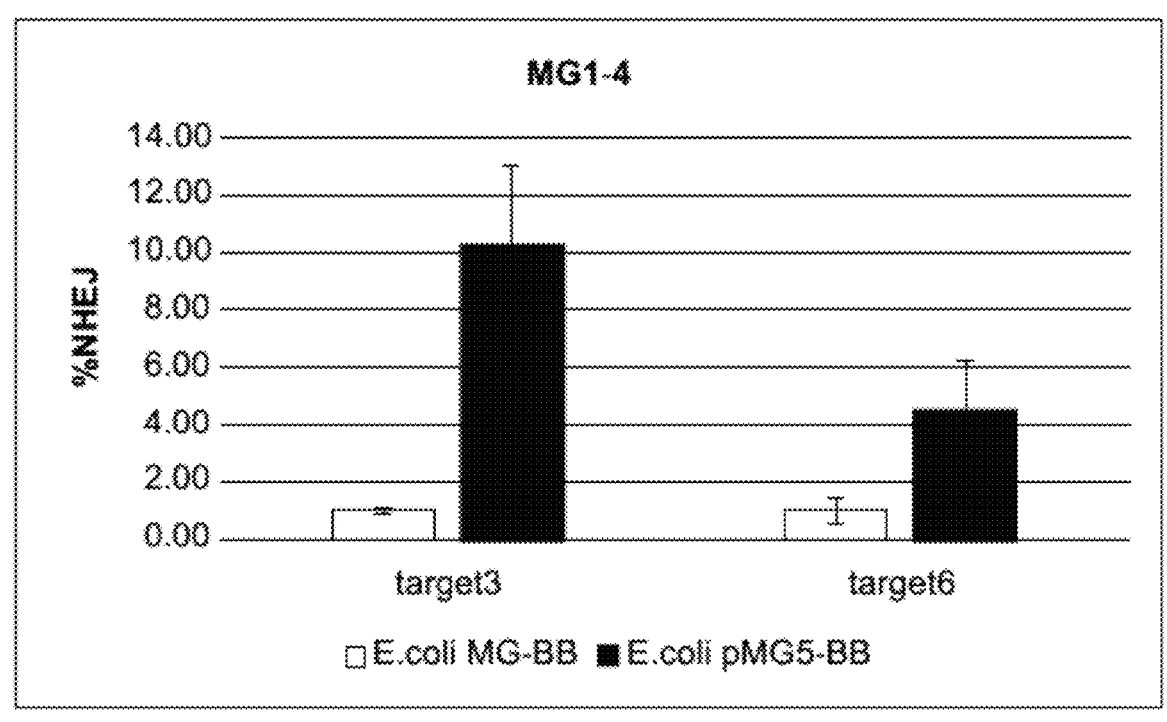
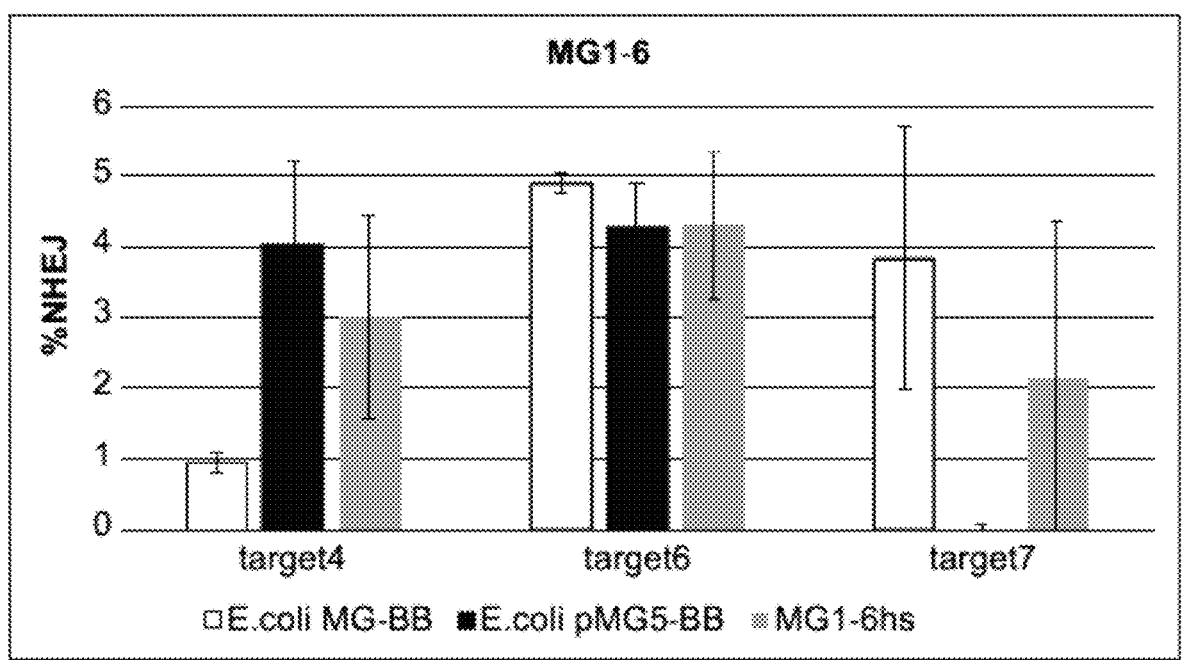
FIG. 12

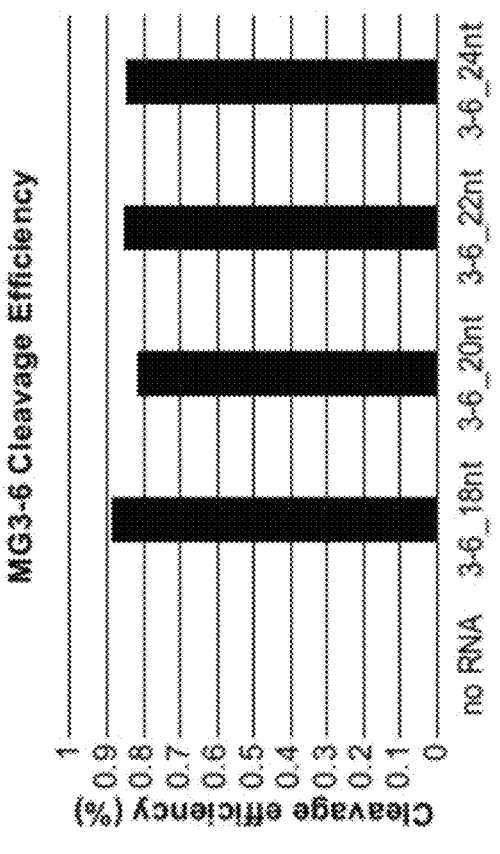
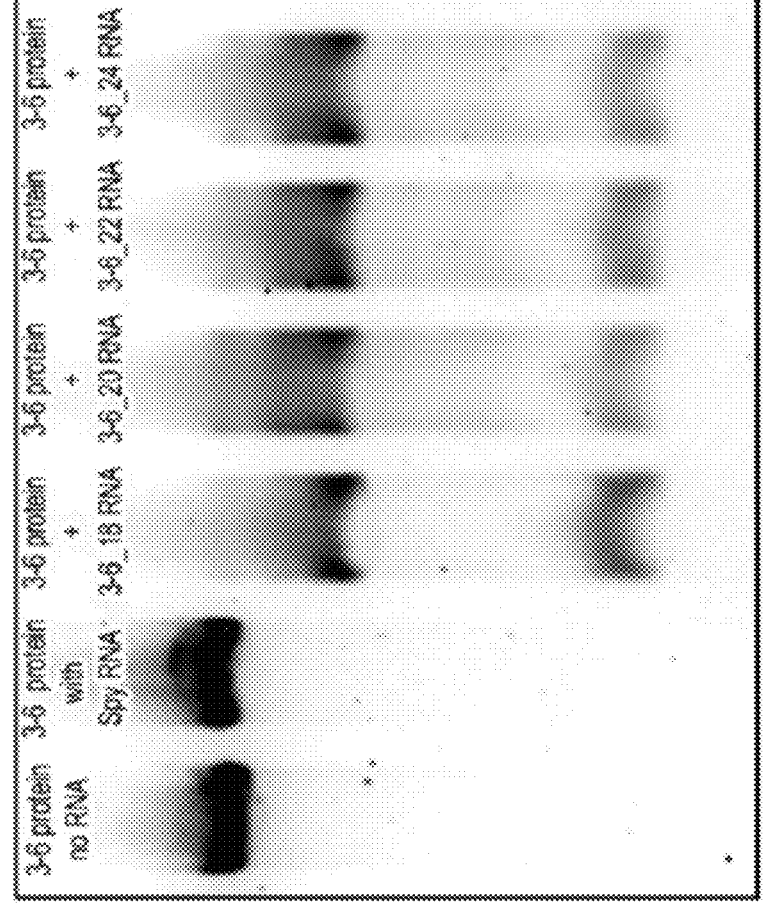
FIG. 13

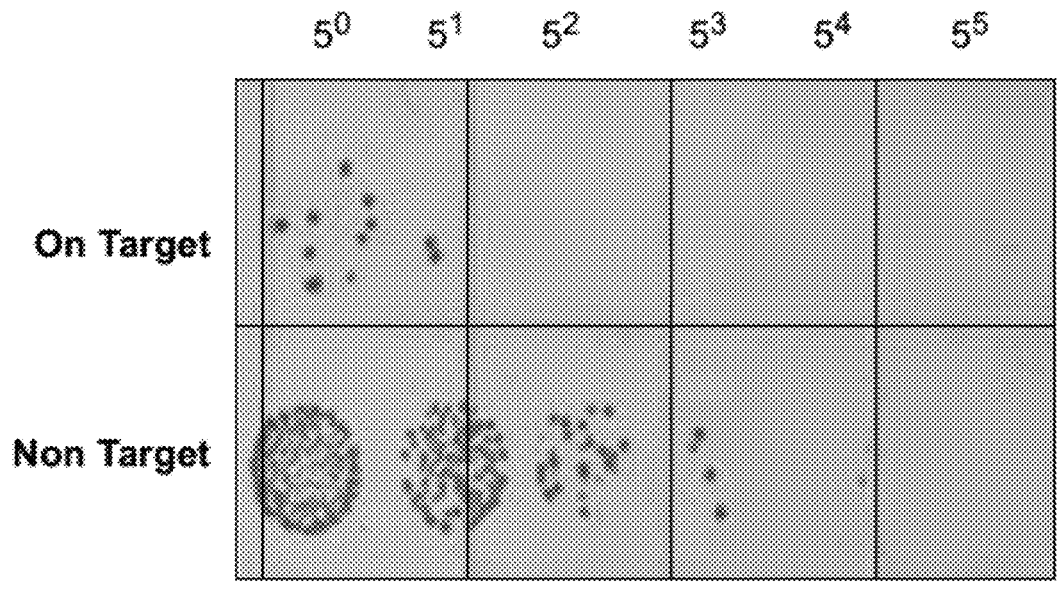
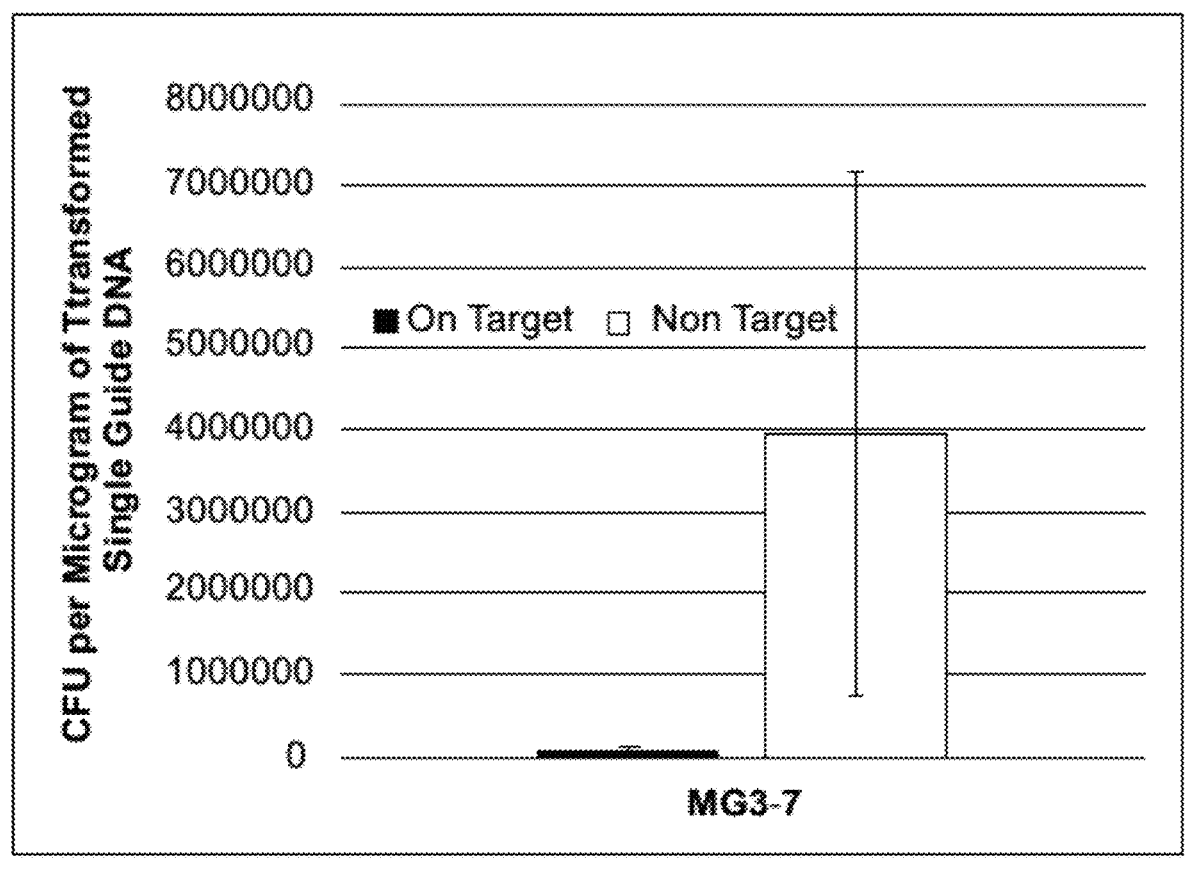
FIG. 14

Gel 7

Gel 8

Gel 9

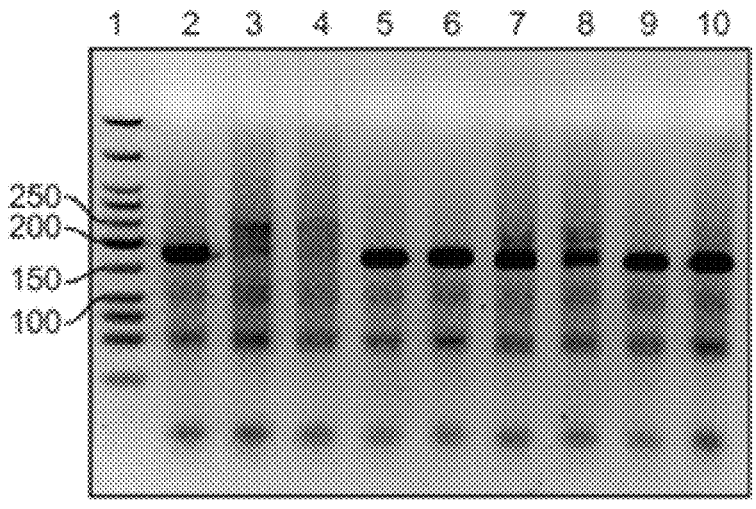
Gel 10
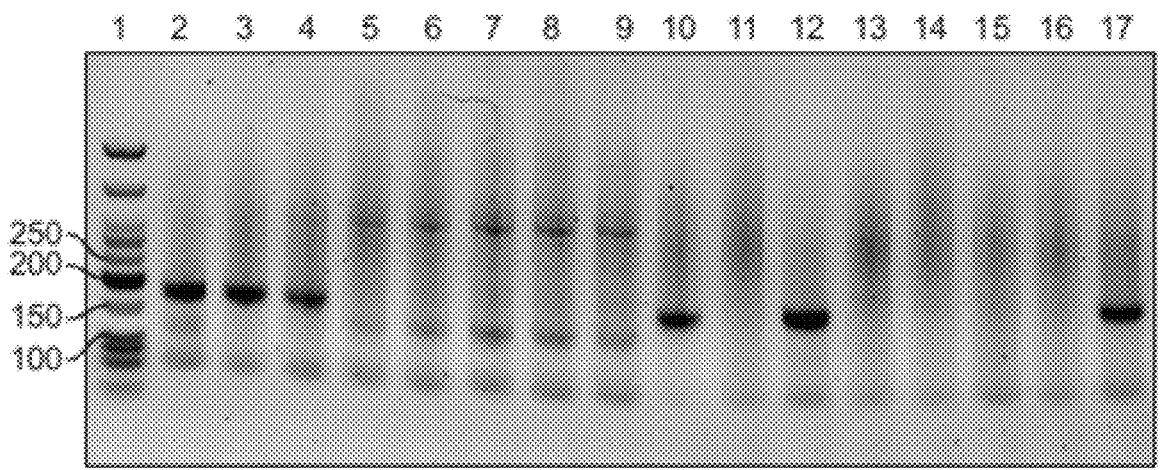
Gel 11
FIG. 20

MG3-6

MG3-7

MG4-2

MG4-5

MG14-1

MG15-1
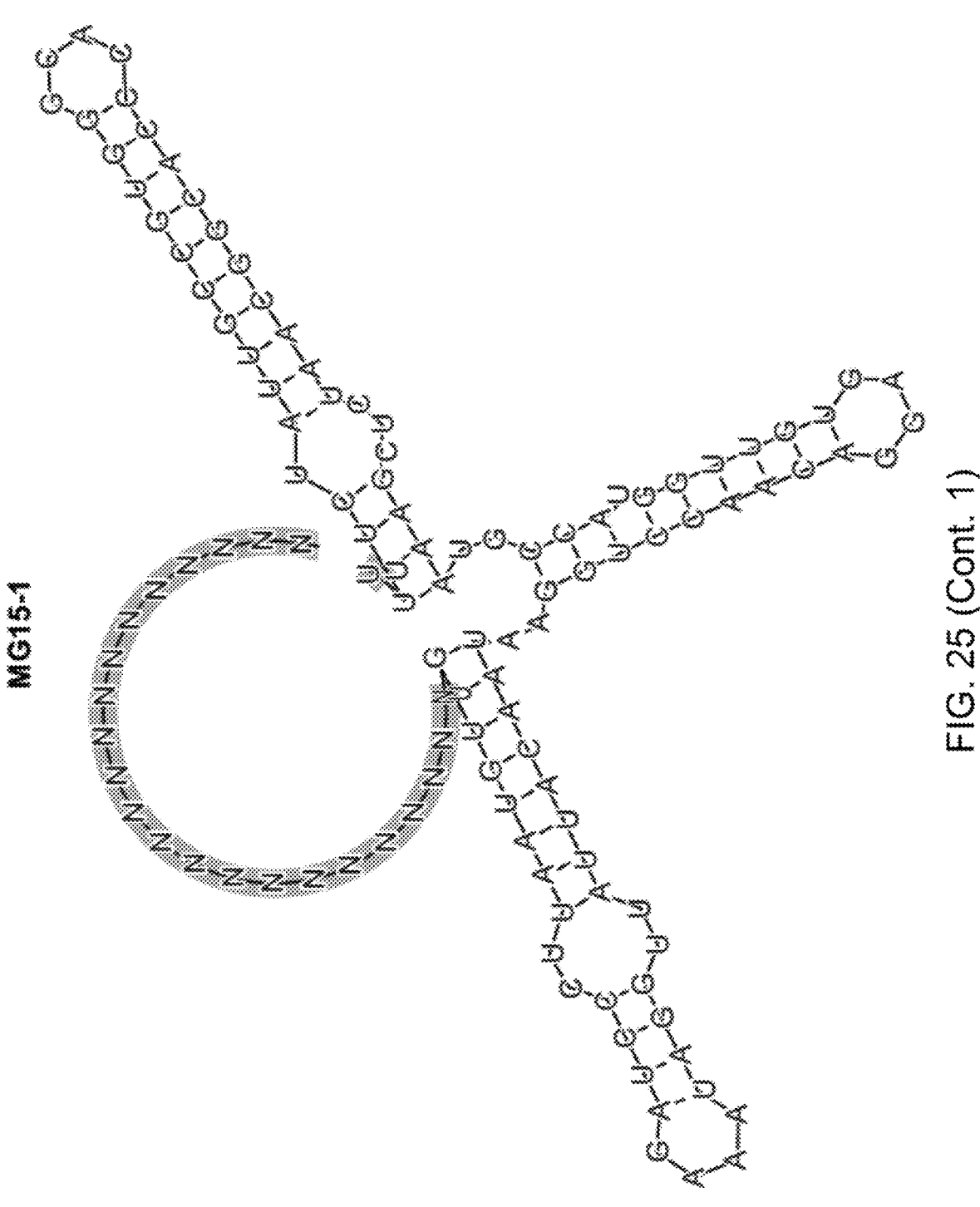
FIG. 25 (Cont. 1)

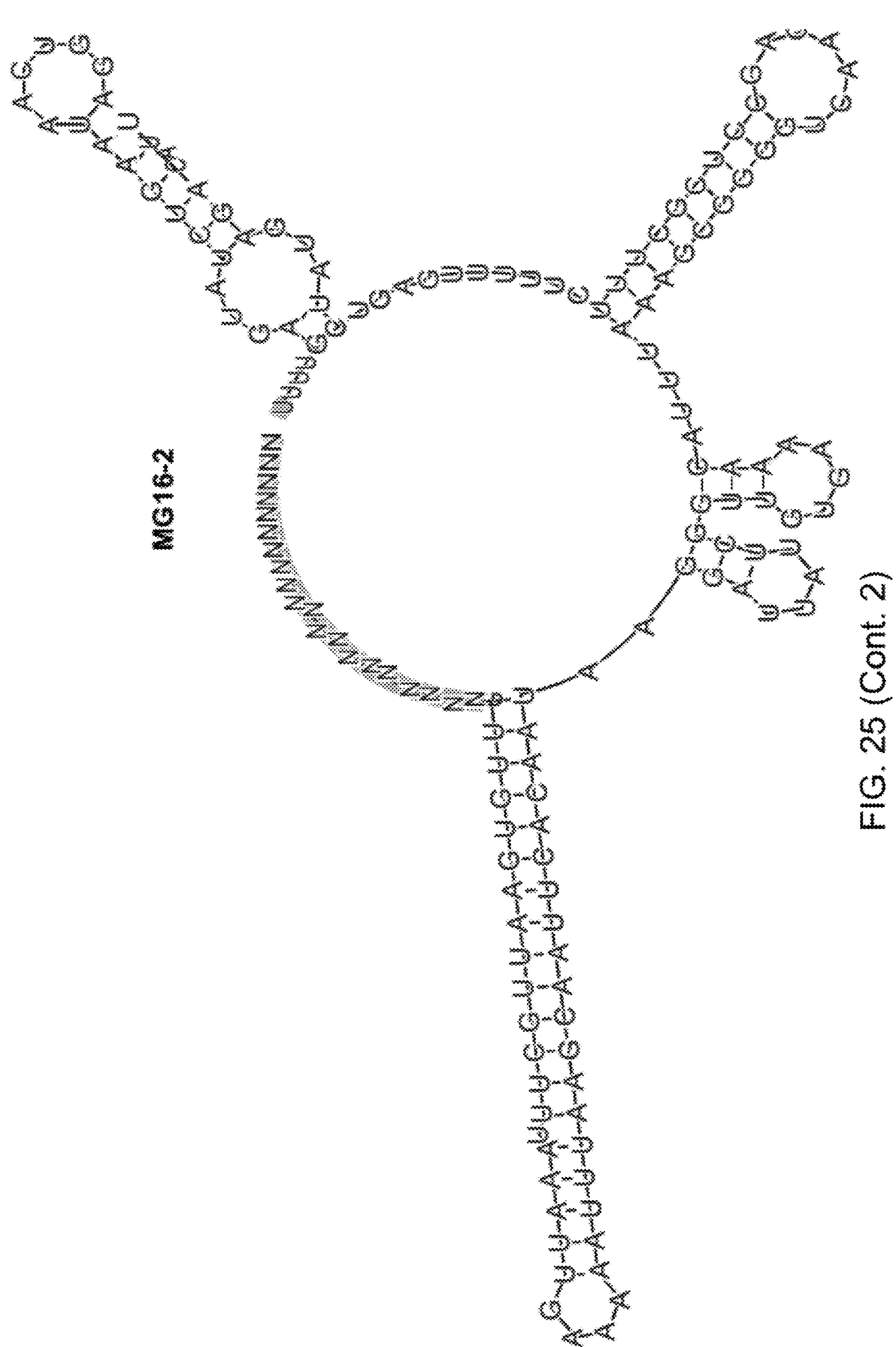
MG16-2
FIG. 25 (Cont. 2)

MG23-1

MG21-1

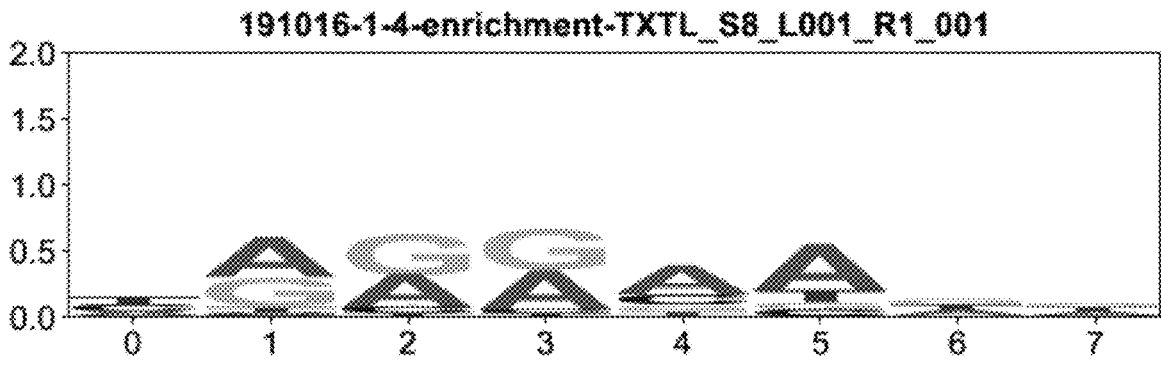
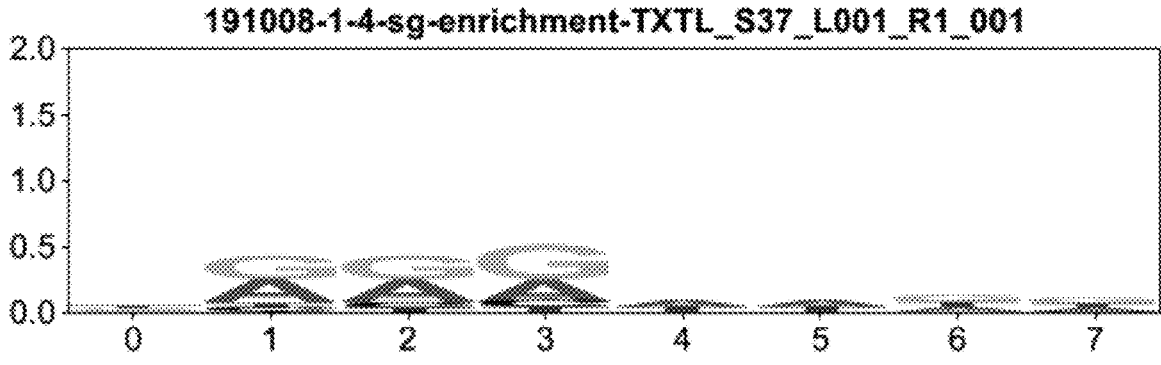
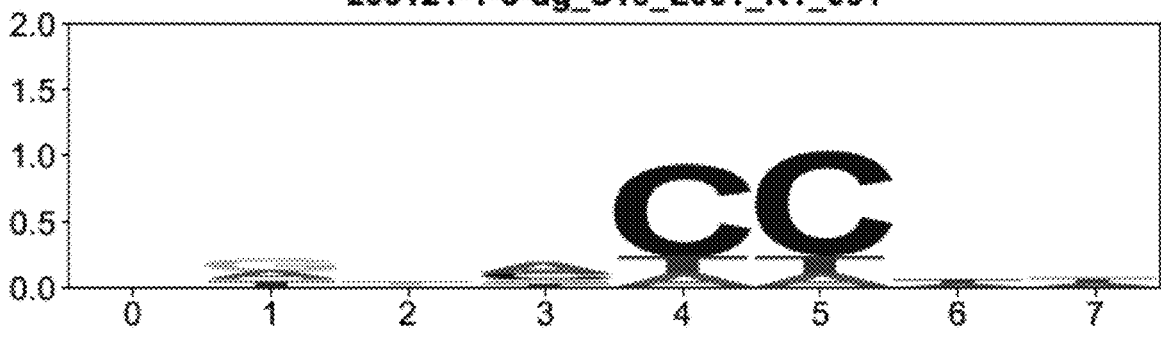
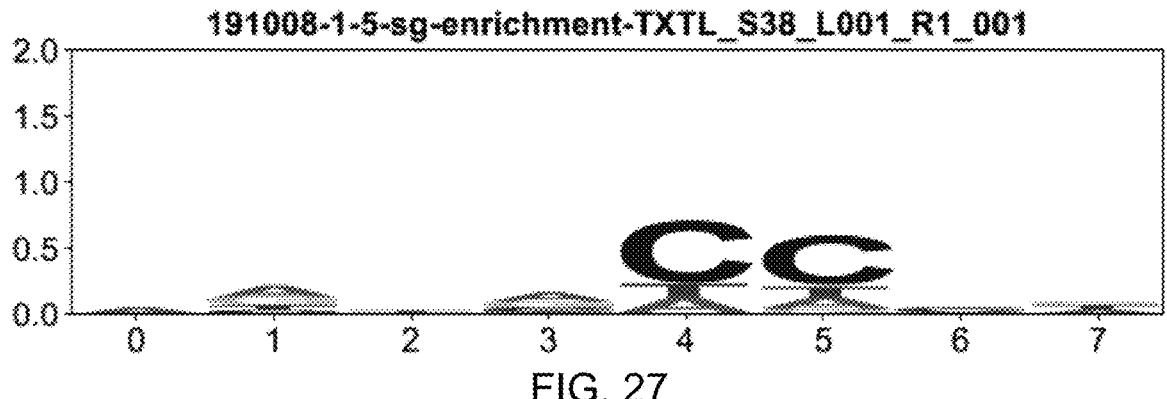
FIG. 27

MG1-6 Native PAM
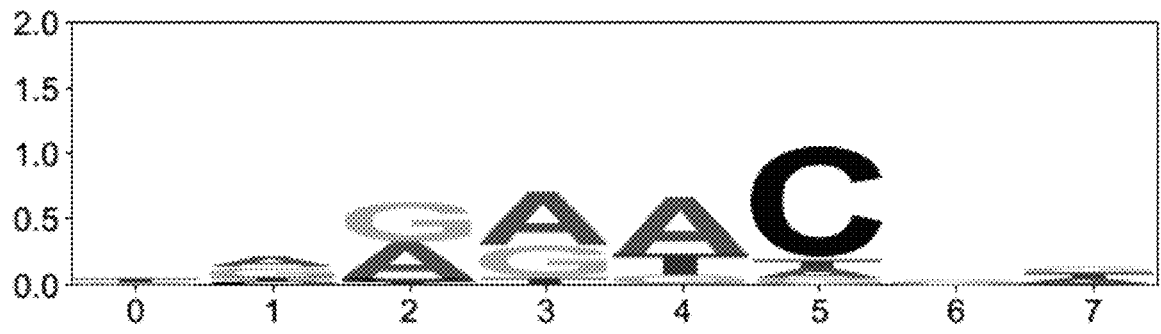
MG1-6 Synthetic PAM
191008-1-6-sg-enrichment-TXTL_S39_L001_R1_001
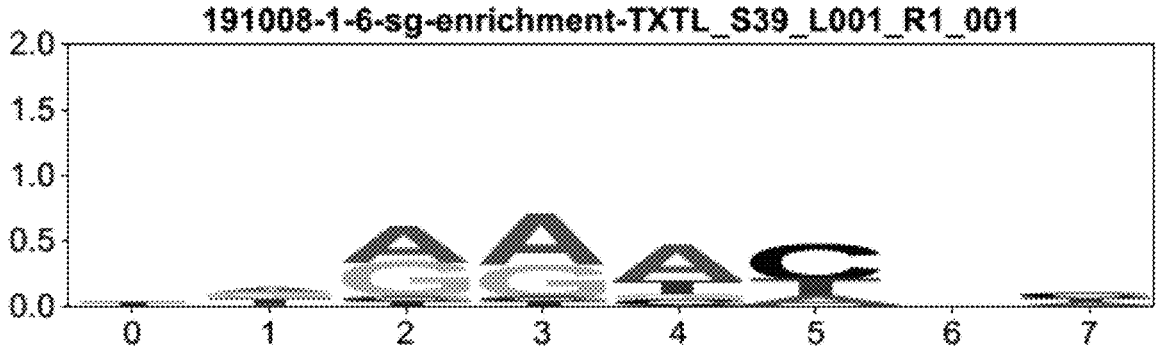
MG1-7 Native PAM
200121-1-7-dg_S16_L001_R1_001
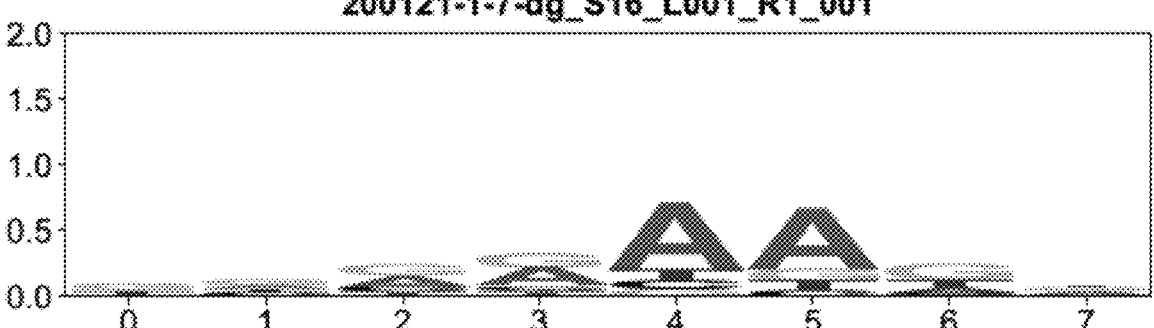
MG2-1 Native PAM
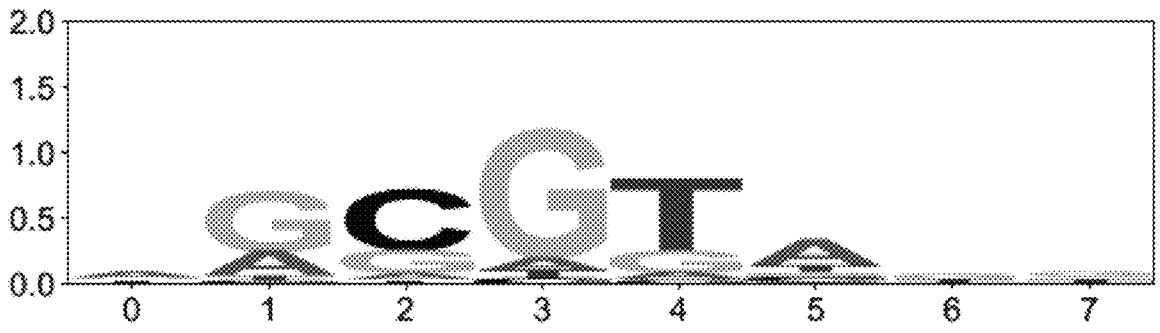
FIG. 28

MG2-7 Synthetic PAM
200121-2-7-sg_S4_L001_R1_001
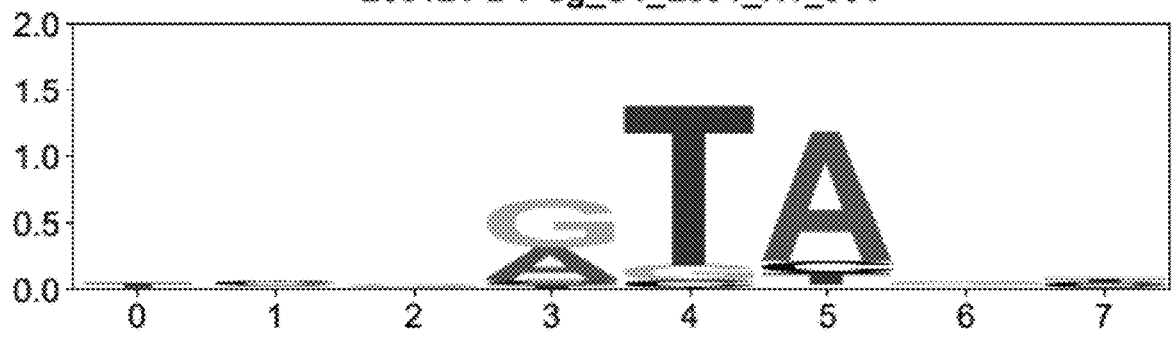
MG3-6 Native PAM
200121-3-6-dg_S17_L001_R1_001
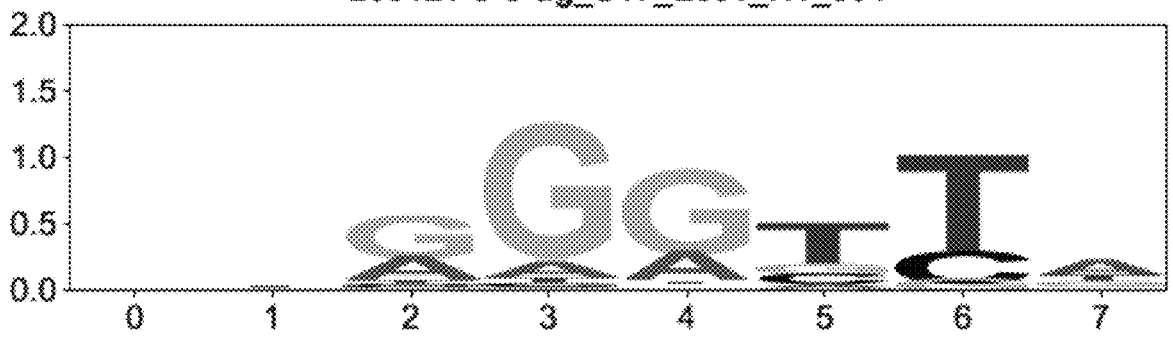
MG3-6 Synthetic PAM
200121-3-6-sg_S8_L001_R1_001
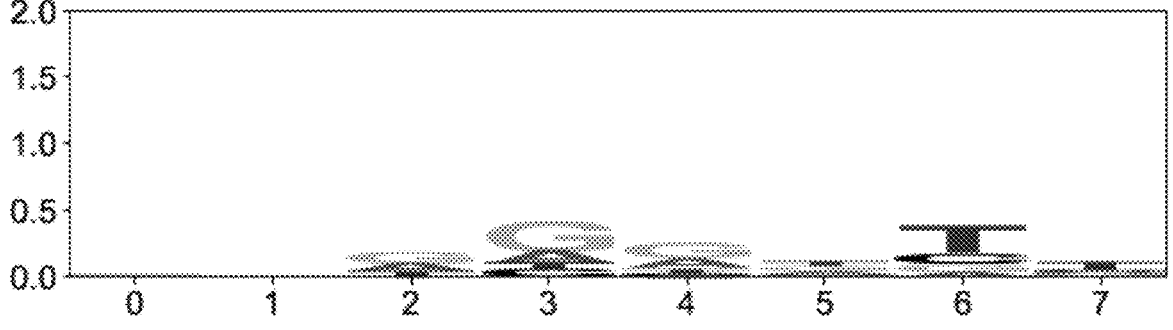
MG3-7 Native PAM
200121-3-7-dg_S18_L001_R1_001
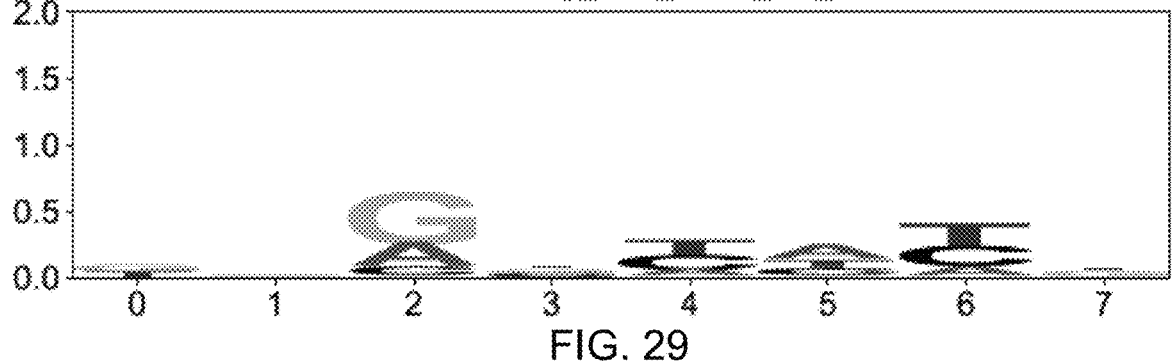
FIG. 29

MG3-7 Synthetic PAM
200121-3-7-sg_S9_L001_R1_001
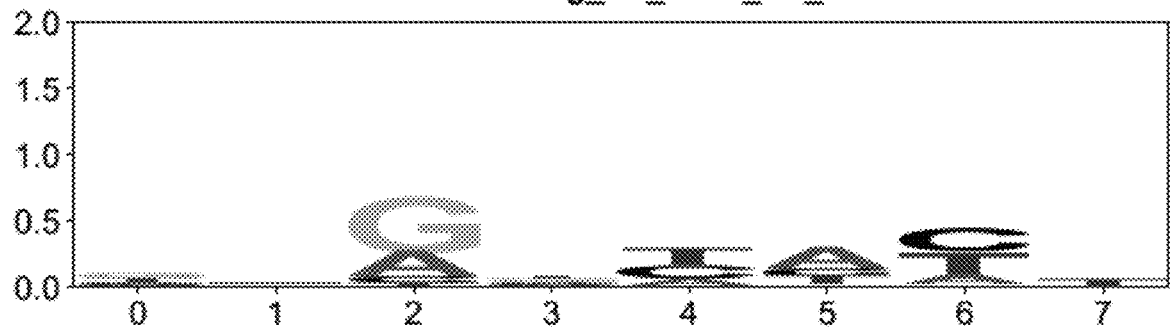
MG3-8 Native PAM
200108-3-8-dg_S19_L001_R1_001
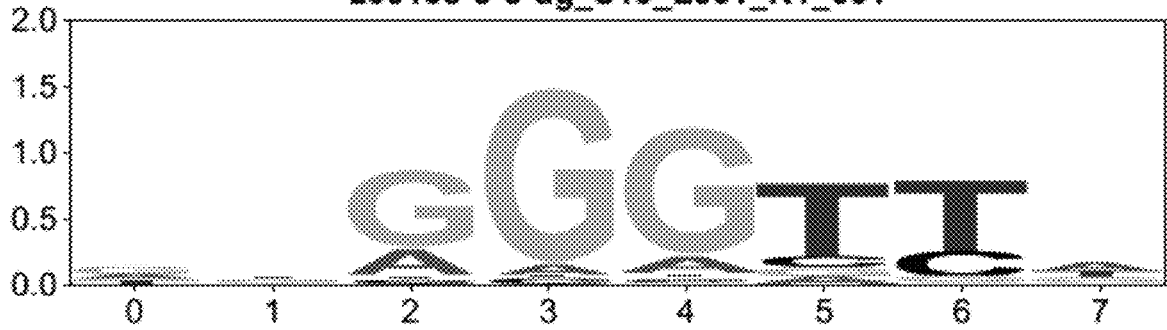
MG4-5 Synthetic PAM
200121-4-5-sg_S10_L001_R1_001
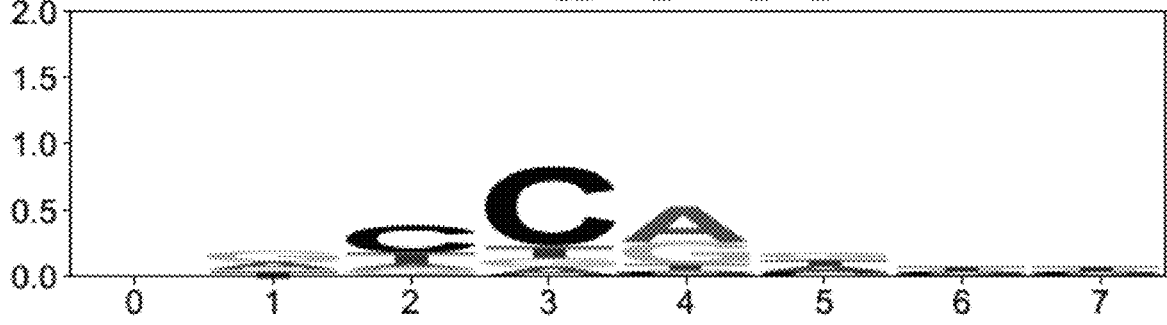
MG14-1 Native PAM
191001-14-1-enrichment-TXTL_S41_L001_R1_001
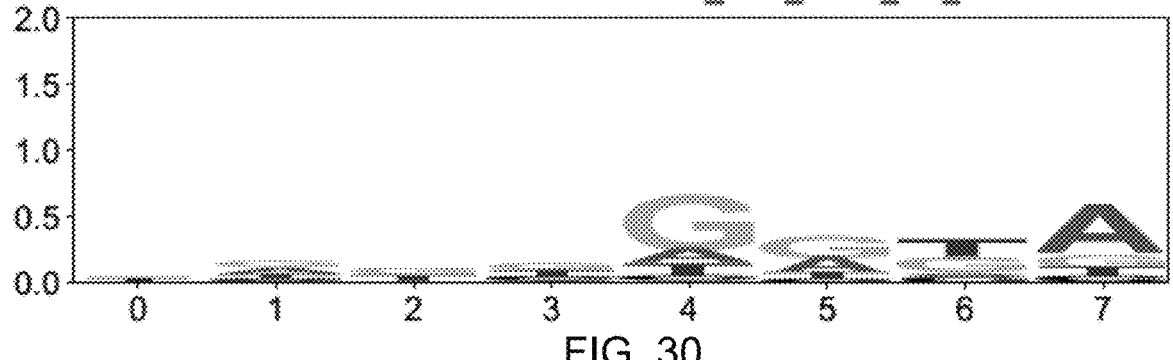
FIG. 30

MG14-1 Synthetic PAM
200121-14-1-sg_S12_L001_R1_001
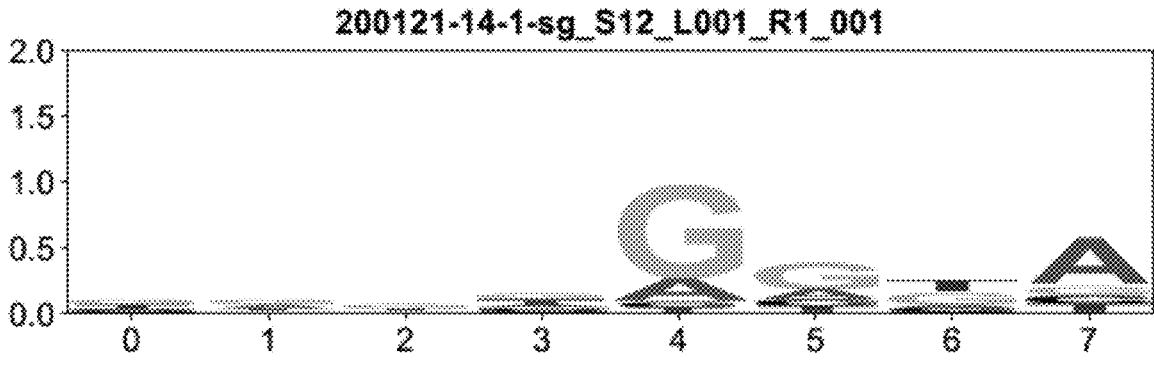
MG15-1 Native PAM
191001-15-1-enrichment-TXTL_S42_L001_R1_001
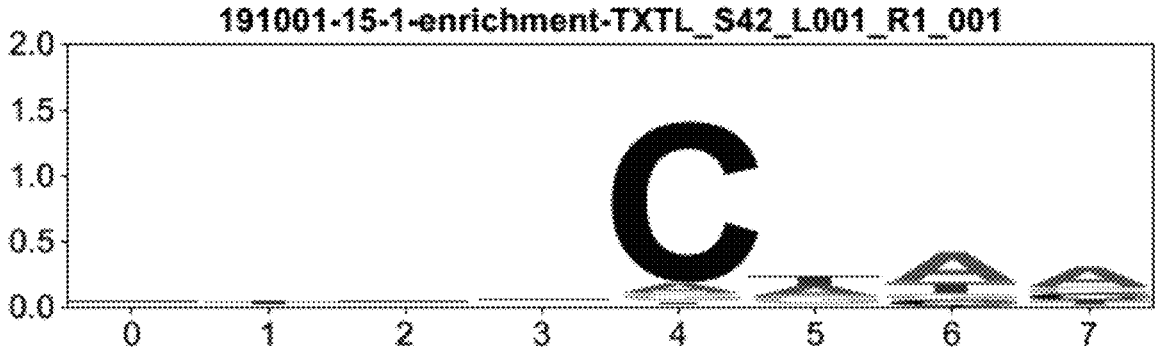
MG15-1 Synthetic PAM
200121-15-1-sg_S13_L001_R1_001
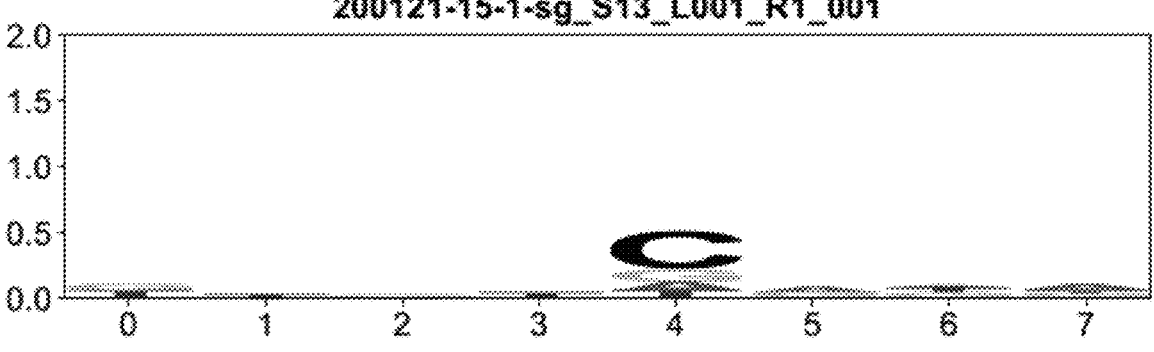
MG16-2 Synthetic PAM
200121-16-2-sg_S6_L001_R1_001
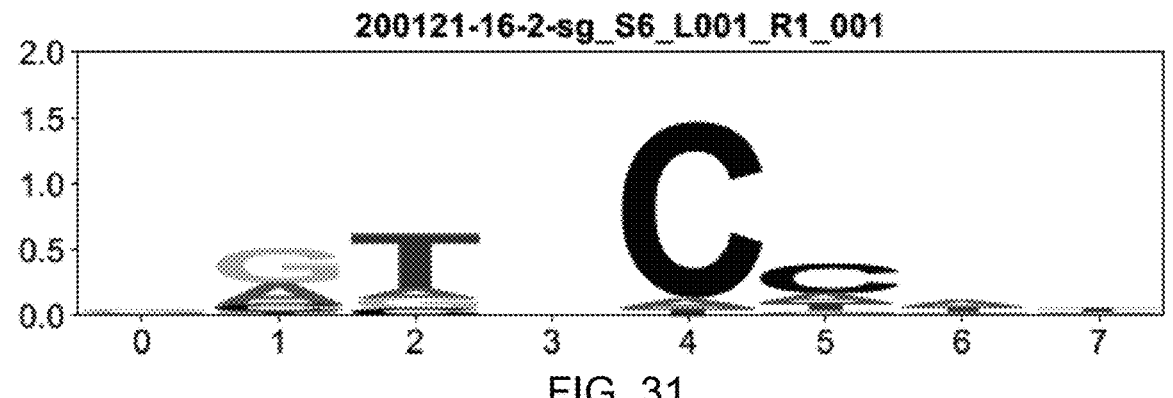
FIG. 31

MG18-1 Native PAM
200114-18-1-dg_S20_L001_R1_001
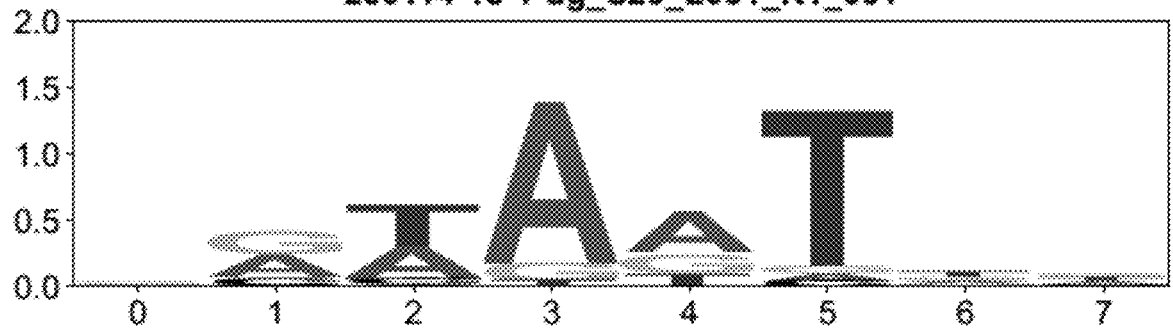
MG18-1 Synthetic PAM
200121-18-1-sg_S5_L001_R1_001
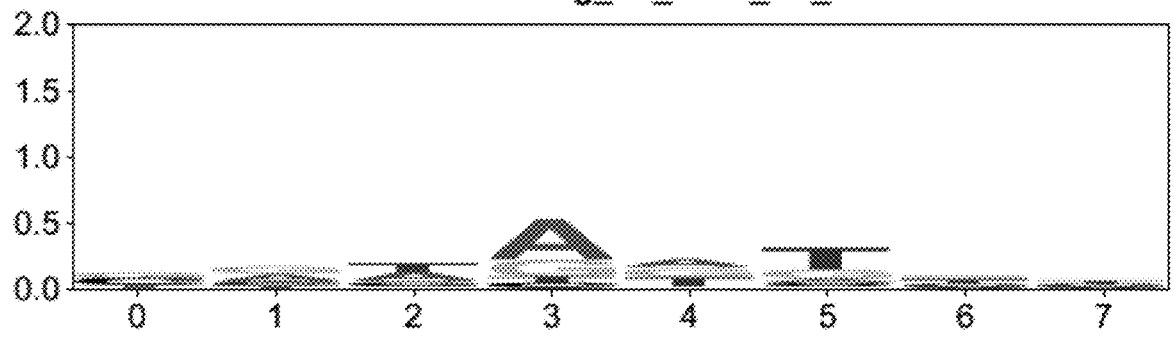
MG21-1 Synthetic PAM
200121-21-1-sg_S1_L001_R1_001
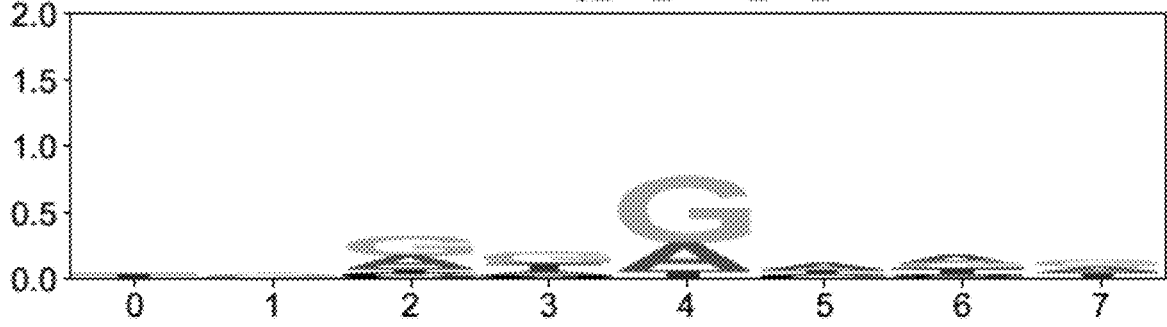
MG22-1 Synthetic PAM
200121-22-1-sg_S2_L001_R1_001
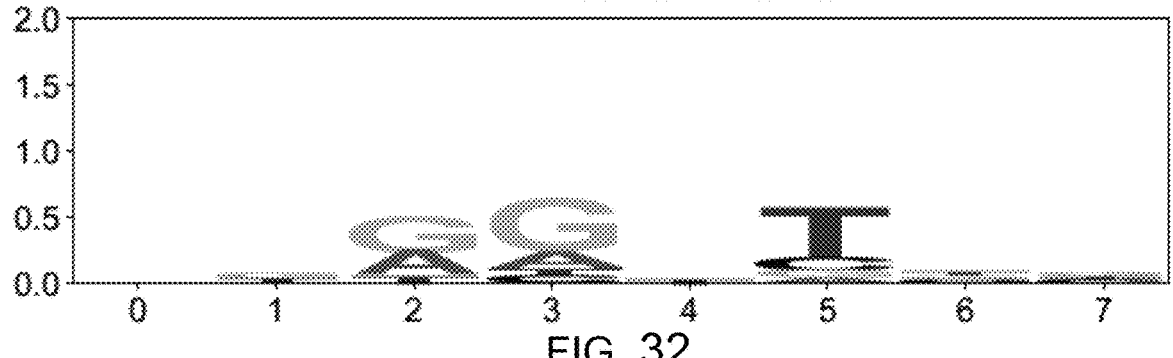
FIG. 32

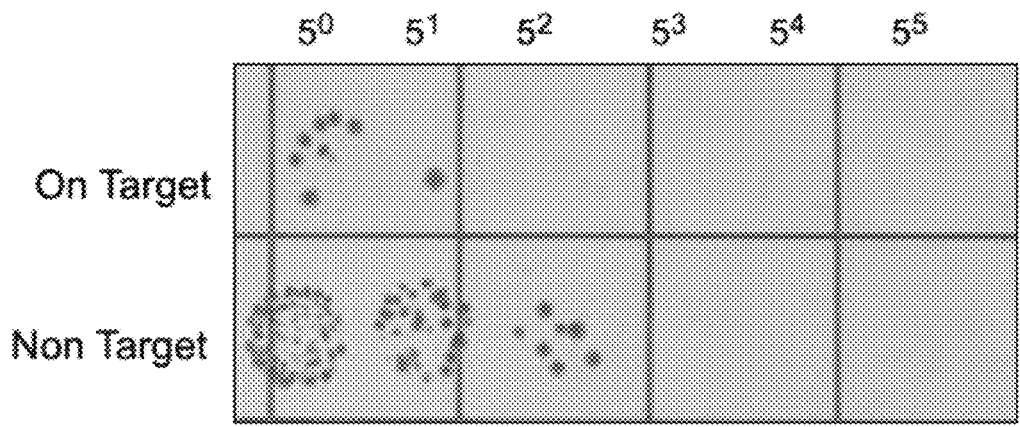
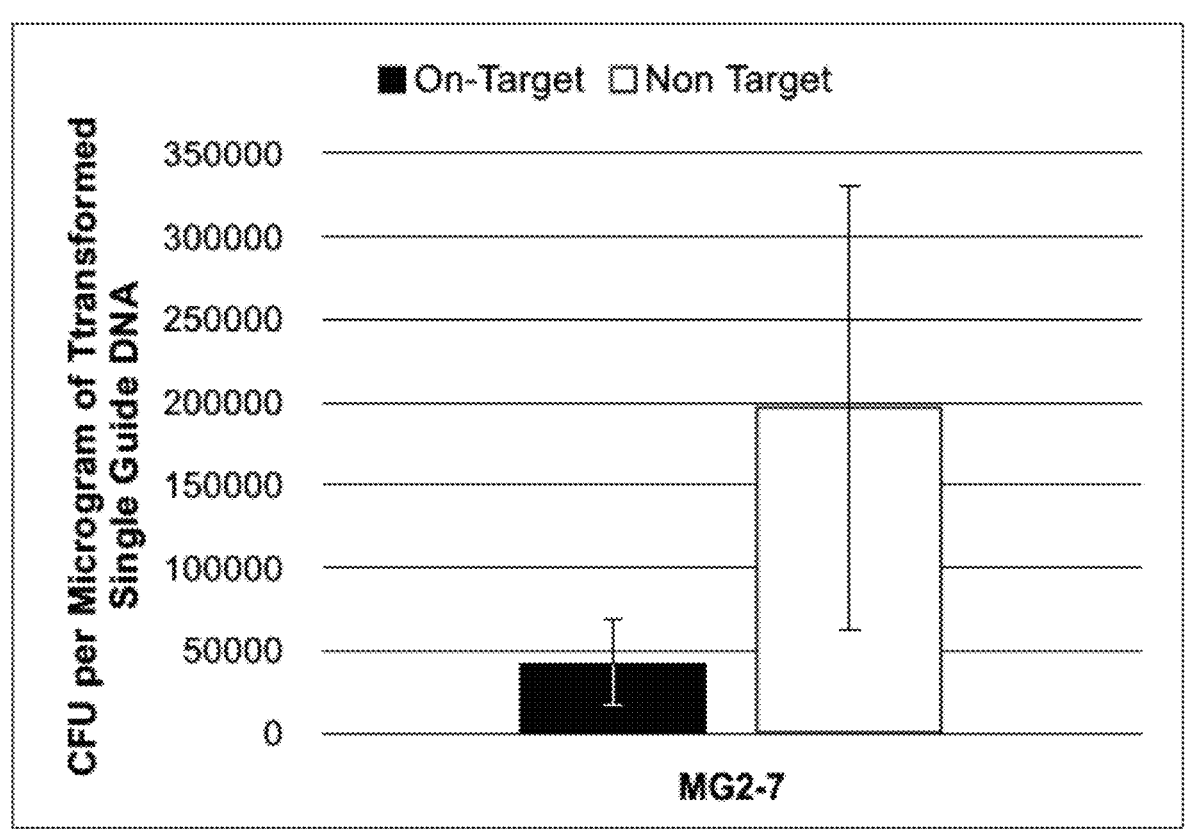
FIG. 34

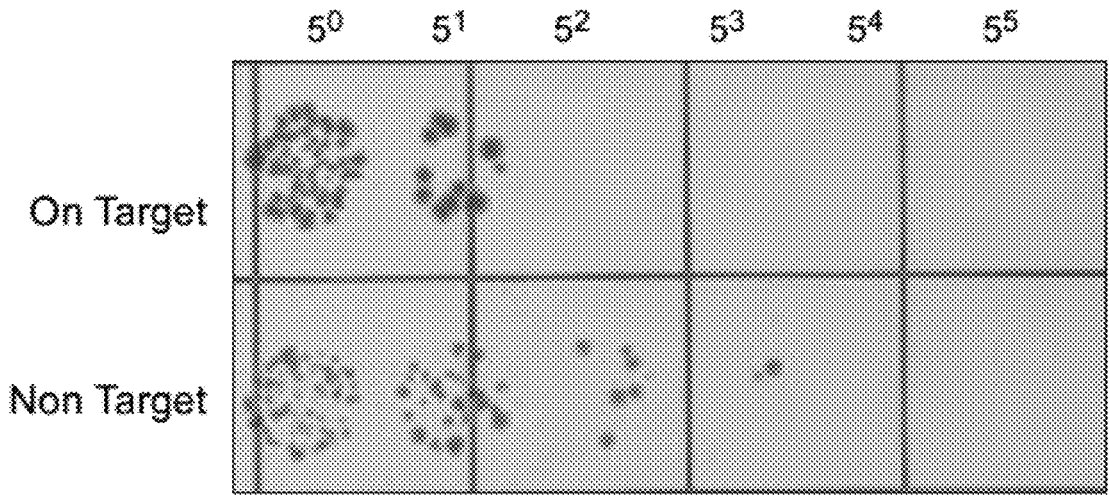
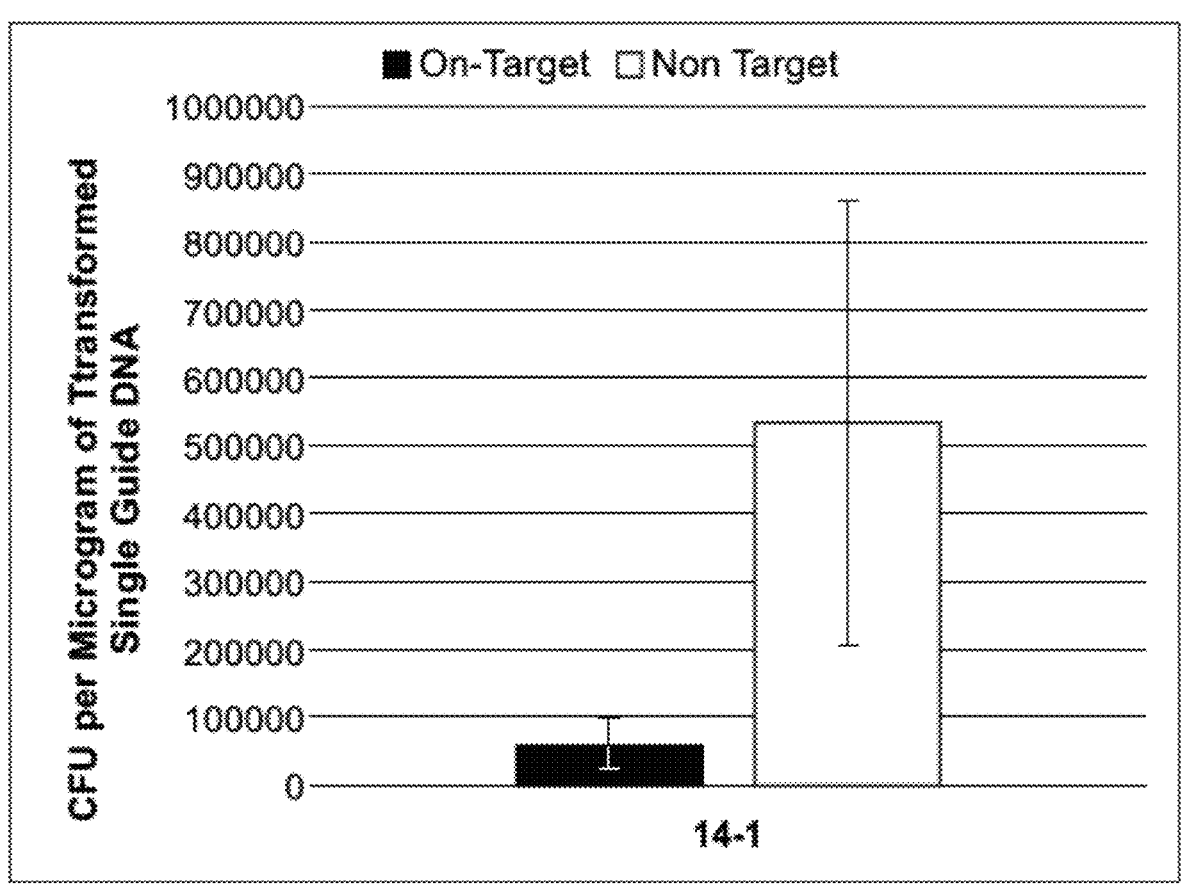
FIG. 35

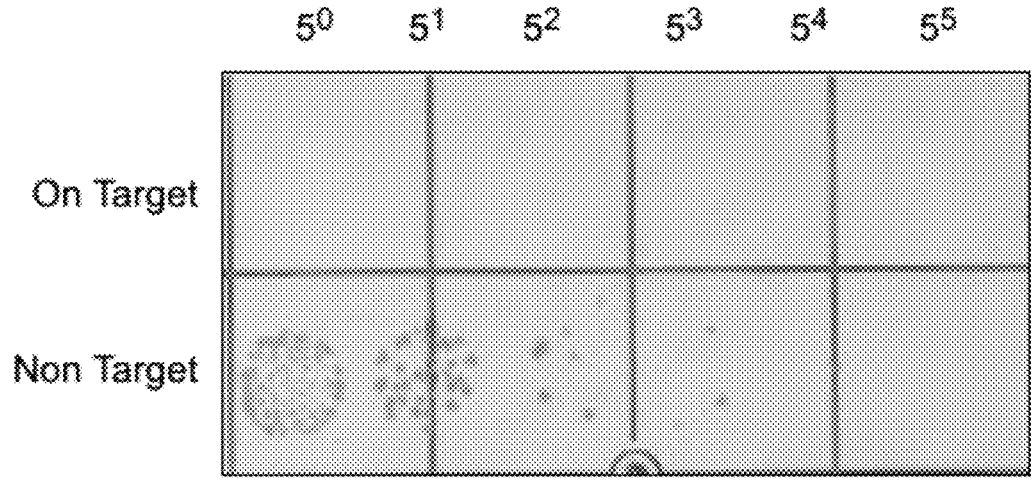
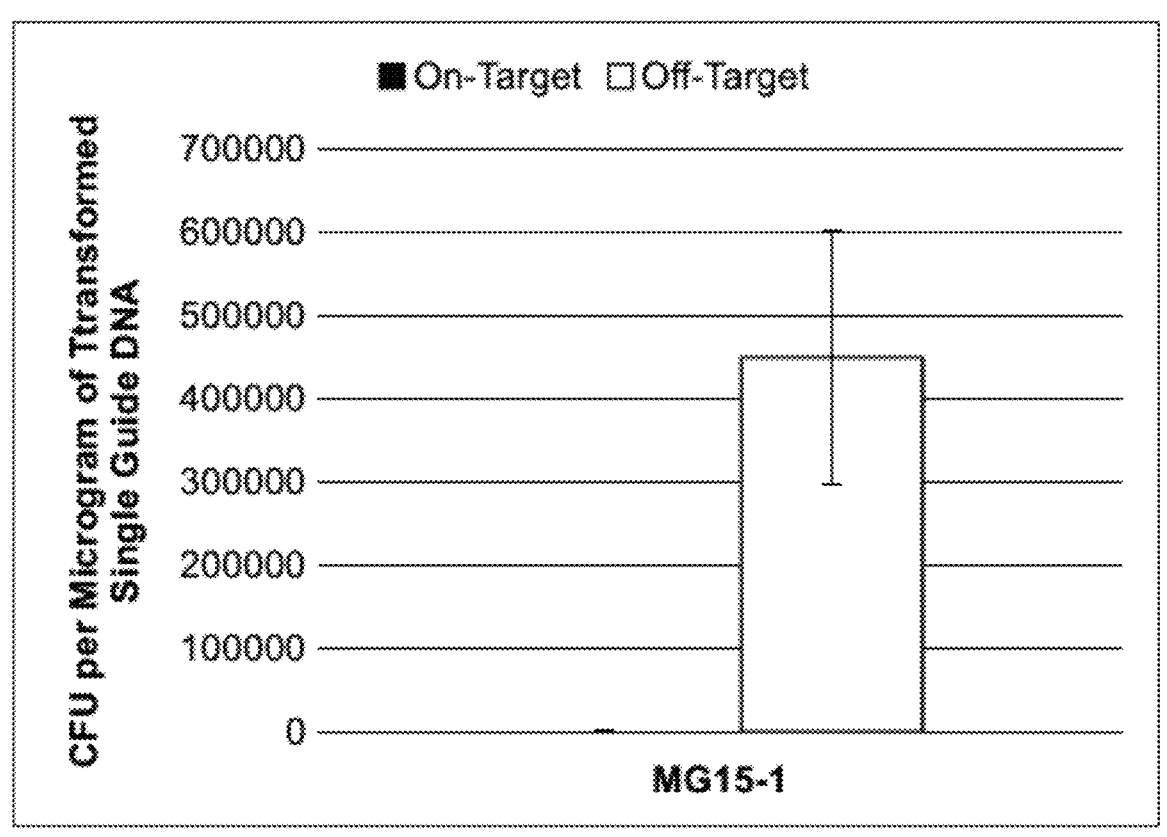
FIG. 36

ENZYMES WITH RUVC DOMAINS

CROSS-REFERENCE

This application is a divisional of U.S. application Ser. No. 17/193,173 filed on Mar. 5, 2021, which is a continuation of U.S. application Ser. No. 16/917,837 filed on Jun. 30, 2020, now U.S. Pat. No. 10,982,200, issued Apr. 20, 2021, which is a continuation in part of International Application No. PCT/US2020/018432 filed on Feb. 14, 2020, entitled "ENZYMES WITH RUVC DOMAINS", which application claims the benefit of U.S. Provisional Application No. 62/874,414 filed on Jul. 15, 2019, 62/805,899 filed on Feb. 14, 2019, 62/805,868 filed on Feb. 14, 2019, and 62/805,878 filed on Feb. 14, 2019. Said U.S. application Ser. No. 16/917,837 also claims the benefit of U.S. Provisional Application No. 63/022,320, filed on May 8, 2020, entitled "ENZYMES WITH RUVC DOMAINS". All of these applications are incorporated by reference herein in their entireties

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR/Cas complexes has only been recognized relatively recently, leading to the use of recombinant CRISPR/Cas systems in diverse DNA manipulation and gene editing applications.

SEQUENCE LISTING

The instant application contains a Sequence Listing which has been submitted electronically in XML format and is hereby incorporated by reference in its entirety. Said XML copy, created on May 17, 2024, is named 55921-703.401.xml and is 12,367,113 bytes in size.

SUMMARY

In some aspects, the present disclosure provides for an engineered nuclease system, comprising: (a) an endonuclease comprising a RuvC_III domain and an HNH domain, wherein the endonuclease is derived from an uncultivated microorganism, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease. In some embodiments, the RuvC_III domain comprises a sequence with at least 70%, at least 75%, at least 80% or at least 90% sequence identity to any one of SEQ ID NOs: 1827-3637.

In some aspects, the present disclosure provides for an engineered nuclease system comprising: (a) an endonuclease comprising a RuvC_III domain having at least 75% sequence identity to any one of SEQ ID NOs: 1827-3637; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some aspects, the present disclosure provides for an engineered nuclease system comprising: (a) an endonuclease configured to bind to a protospacer adjacent motif (PAM) sequence comprising SEQ ID NOs: 5512-5537, wherein the endonuclease is a class 2, type II Cas endonuclease; and (b) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some embodiments, the endonuclease is derived from an uncultivated microorganism. In some embodiments, the endonuclease has not been engineered to bind to a different PAM sequence. In some embodiments, the endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 5476-5511 and SEQ ID NO: 5538.

In some aspects, the present disclosure provides for an engineered nuclease system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80% sequence identity to about 60 to 90 consecutive nucleotides selected from any one of SEQ ID NOs: 5476-5511 and SEQ ID NO: 5538; and (b) a class 2, type II Cas endonuclease configured to bind to the engineered guide ribonucleic acid. In some embodiments, the endonuclease is configured to bind to a protospacer adjacent motif (PAM) sequence selected from the group comprising SEQ ID NOs: 5512-5537.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence.

In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of the endonuclease. In some embodiments, the NLS comprises a sequence selected from SEQ ID NOs: 5597-5612.

In some embodiments, the engineered nuclease system further comprises a single- or double-stranded DNA repair template comprising from 5' to 3': a first homology arm comprising a sequence of at least 20 nucleotides 5' to the target deoxyribonucleic acid sequence, a synthetic DNA sequence of at least 10 nucleotides, and a second homology arm comprising a sequence of at least 20 nucleotides 3' to the target sequence. In some embodiments, the first or second homology arm comprises a sequence of at least 40, 80, 120, 150, 200, 300, 500, or 1,000 nucleotides.

In some embodiments, the system further comprises a source of $Mg^{2+}$.

In some embodiments, the endonuclease and the tracr ribonucleic acid sequence are derived from distinct bacterial species within a same phylum. In some embodiments, the endonuclease is derived from a bacterium belonging to a genus Dermabacter. In some embodiments, the endonuclease is derived from a bacterium belonging to Phylum Verrucomicrobia, Phylum Candidatus Peregrinibacteria, or Phylum Candidatus Melainabacteria. In some embodiments, the endonuclease is derived from a bacterium comprising a 16S rRNA gene having at least 90% identity to any one of SEQ ID NOs: 5592-5595.

In some embodiments, the HNH domain comprises a sequence with at least 70% or at least 80% identity to any one of SEQ ID NOs: 5638-5460. In some embodiments, the endonuclease comprises SEQ ID NOs: 1-1826 or a variant thereof having at least 55% identity thereto. In some embodiments, the endonuclease comprises a sequence at least 70%, 80%, or 90% identical to a sequence selected from the group consisting of SEQ ID NOs: 1827-1830 or SEQ ID NOs: 1827-2140.

In some embodiments, the endonuclease comprises a sequence at least 70%, 80%, or 90% identical to a sequence selected from the group consisting of SEQ ID NOs: 3638-3641 or SEQ ID NOs: 3638-3954. In some embodiments, the endonuclease comprises at least 1, at least 2, at least 3, at least 4, or at least 5 peptide motifs selected from the group consisting of SEQ ID NOs: 5615-5632. In some embodiments, the endonuclease comprises a sequence at least 70%, 80%, or 90% identical to a sequence selected from the group consisting of SEQ ID NOs: 1-4 or SEQ ID NOs: 1-319.

In some embodiments, the guide RNA structure comprises a sequence at least 70%, 80%, or 90% identical to a sequence selected from the group consisting of SEQ ID NOs: 5461-5464, SEQ ID NOs: 5476-5479, or SEQ ID NOs: 5476-5489. In some embodiments, the guide RNA structure comprises an RNA sequence predicted to comprise a hairpin consisting of a stem and a loop, wherein the stem comprises at least 10, at least 12 or at least 14 base-paired ribonucleotides, and an asymmetric bulge within 4 base pairs of the loop.

In some embodiments, the endonuclease is configured to bind to a PAM comprising a sequence selected from the group consisting of SEQ ID NOs: 5512-5515 or SEQ ID NOs: 5527-5530.

In some embodiments: (a) the endonuclease comprises a sequence at least 70%, at least 80%, or at least 90% identical to SEQ ID NO: 1827; (b) the guide RNA structure comprises a sequence at least 70%, at least 80%, or at least 90% identical to at least one of SEQ ID NO: 5461 or SEQ ID NO: 5476; and (c) the endonuclease is configured to bind to a PAM comprising SEQ ID NO: 5512 or SEQ ID NO: 5527. In some embodiments: (a) the endonuclease comprises a sequence at least 70%, at least 80%, or at least 90% identical to SEQ ID NO: 1828; (b) the guide RNA structure comprises a sequence at least 70%, at least 80%, or at least 90% identical to at least one of SEQ ID NO: 5462 or SEQ ID NO: 5477; and (c) the endonuclease is configured to bind to a PAM comprising SEQ ID NO: 5513 or SEQ ID NO: 5528.

In some embodiments: (a) the endonuclease comprises a sequence at least 70%, at least 80%, or at least 90% identical to SEQ ID NO: 1829; (b) the guide RNA structure comprises a sequence at least 70%, at least 80%, or at least 90% identical to at least one of SEQ ID NO: 5463 or SEQ ID NO: 5478; and (c) the endonuclease is configured to bind to a PAM comprising SEQ ID NO: 5514 or SEQ ID NO: 5529.

In some embodiments: (a) the endonuclease comprises a sequence at least 70%, at least 80%, or at least 90% identical to SEQ ID NO: 1830; (b) the guide RNA structure comprises a sequence at least 70%, at least 80%, or at least 90% identical to at least one of SEQ ID NO: 5464 or SEQ ID NO: 5479; and (c) the endonuclease is configured to bind to a PAM comprising SEQ ID NO: 5515 or SEQ ID NO: 5530.

In some embodiments, the endonuclease comprises a sequence at least 70%, 80%, or 90% identical to a sequence selected from the group consisting of SEQ ID NOs: 2141-2142 or SEQ ID NOs: 2141-2241. In some embodiments, the endonuclease comprises a sequence at least 70%, 80%, or 90% identical to a sequence selected from the group consisting of SEQ ID NOs: 3955-3956 or SEQ ID NOs: 3955-4055. In some embodiments, the endonuclease comprises at least 1, at least 2, at least 3, at least 4, or at least 5 peptide motifs selected from the group consisting of SEQ ID NOs: 5632-5638. In some embodiments, the endonuclease comprises a sequence at least 70%, 80%, or 90% identical to a sequence selected from the group consisting of SEQ ID NOs: 320-321 or SEQ ID NOs: 320-420. In some embodiments, the guide RNA structure comprises a sequence at least 70%, 80%, or 90% identical to a sequence selected from the group consisting of SEQ ID NO: 5465, SEQ ID NOs: 5490-5491 or SEQ ID NOs: 5490-5494. In some embodiments, the guide RNA structure comprises a tracr ribonucleic acid sequence comprising a hairpin comprising at least 8, at least 10, or at least 12 base-paired ribonucleotides. In some embodiments, the endonuclease is configured to bind to a PAM comprising a sequence selected from the group consisting of SEQ ID NOs: 5516 and SEQ ID NOs: 5531. In some embodiments: (a) the endonuclease comprises a sequence at least 70%, 80%, or 90% identical to SEQ ID NO: 2141; (b) the guide RNA structure comprises a sequence at least 70%, 80%, or 90% identical to SEQ ID NO: 5490; and (c) the endonuclease is configured to binding to a PAM comprising SEQ ID NO: 5531. In some embodiments: (a) the endonuclease comprises a sequence at least 70%, 80%, or 90% identical to SEQ ID NO: 2142; (b) the guide RNA structure comprises a sequence at least 70%, 80%, or 90% identical to SEQ ID NO: 5465 or SEQ ID NO: 5491; and (c) the endonuclease is configured to binding to a PAM comprising SEQ ID NO: 5516.

In some embodiments, the endonuclease comprises a sequence at least 70%, 80%, or 90% identical to a sequence selected from the group consisting of SEQ ID NOs: 2245-2246. In some embodiments, the endonuclease comprises a sequence at least 70%, 80%, or 90% identical to a sequence selected from the group consisting of SEQ ID NOs: 4059-4060. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 424-425. In some embodiments, the guide RNA structure comprises a sequence at least 70%, 80%, or 90% identical to a sequence selected from the group consisting of SEQ ID NOs: 5498-5499 and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin.

In some embodiments, the endonuclease comprises a sequence at least 70%, 80%, or 90% identical to a sequence selected from the group consisting of SEQ ID NOs: 2242-2244 or SEQ ID NOs: 2247-2249. In some embodiments, the endonuclease comprises a sequence at least 70%, 80%, or 90% identical to a sequence selected from the group consisting of SEQ ID NOs: 4056-4058 and SEQ ID NOs 4061-4063. In some embodiments, the endonuclease comprises at least 1, at least 2, at least 3, at least 4, or at least 5 peptide motifs selected from the group consisting of SEQ ID NOs: 5639-5648. In some embodiments, the endonuclease comprises a sequence at least 70%, 80%, or 90% identical to a sequence selected from the group consisting of SEQ ID NOs: 421-423 or SEQ ID NOs: 426-428. In some embodiments, the guide RNA structure comprises a sequence at least 70%, 80%, or 90% identical to a sequence selected from the group consisting of SEQ ID NOs: 5466-5467, SEQ ID NOs: 5495-5497, SEQ ID NO: 5500-5502, and SEQ ID NO: 5539. In some embodiments, the guide RNA structure comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin. In some embodiments, the endonuclease is configured to binding to a PAM comprising a sequence selected from the group consisting of SEQ ID NOs: 5517-5518 or SEQ ID NOs: 5532-5534. In some embodiments: (a) the endonuclease comprises a sequence at least 70%, 80%, or 90% identical to SEQ ID NO: 2247; (b) the guide RNA structure comprises a sequence at least 70%, 80%, or 90% identical to SEQ ID NO: 5500; and (c) the endonuclease is configured to binding to a PAM comprising SEQ ID NO: 5517 or SEQ ID NO: 5532. In some embodiments: (a) the endonuclease comprises a sequence at least 70%, 80%, or 90% identical to SEQ ID NO: 2248; (b) the guide RNA structure comprises a sequence at least 70%, 80%, or 90% identical to SEQ ID NO: 5501; and (c) the endonuclease is configured to binding to a PAM comprising SEQ ID NO: 5518 or SEQ ID NOs: 5533. In some embodiments: (a) the endonuclease comprises a sequence at least 70%, 80%, or 90% identical to SEQ ID NO: 2249; (b) the guide RNA structure comprises a sequence at least 70%, 80%, or 90% identical to SEQ ID NO: 5502; and (c) the endonuclease is configured to binding to a PAM comprising SEQ ID NO: 5534.

In some embodiments, the endonuclease comprises a sequence at least 70%, 80%, or 90% identical to a sequence selected from the group consisting of SEQ ID NO: 2253 or SEQ ID NOs: 2253-2481. In some embodiments, the endonuclease comprises a sequence at least 70%, 80%, or 90% identical to a sequence selected from the group consisting of SEQ ID NO: 4067 or SEQ ID NOs: 4067-4295. In some embodiments, the endonuclease comprises a peptide motif according to SEQ ID NO: 5649. In some embodiments, the endonuclease comprises a sequence at least 70%, 80%, or 90% identical to a sequence selected from the group consisting of SEQ ID NO: 432 or SEQ ID NOs: 432-660. In some embodiments, the guide RNA structure comprises a sequence at least 70%, 80%, or 90% identical to a sequence selected from the group consisting of SEQ ID NO: 5468 or SEQ ID NO: 5503. In some embodiments, the endonuclease is configured to binding to a PAM comprising a sequence selected from the group consisting of SEQ ID NOs: 5519. In some embodiments: (a) the endonuclease comprises a sequence at least 70%, 80%, or 90% identical to SEQ ID NO: 2253; (b) the guide RNA structure comprises a sequence at least 70%, 80%, or 90% identical to SEQ ID NO: 5468 or SEQ ID NO: 5503; and (c) the endonuclease is configured to binding to a PAM comprising SEQ ID NO: 5519.

In some embodiments, the endonuclease comprises a sequence at least 70%, 80%, or 90% identical to a sequence selected from the group consisting of SEQ ID NOs: 2482-2489. In some embodiments, the endonuclease comprises a sequence at least 70%, 80%, or 90% identical to a sequence selected from the group consisting of SEQ ID NOs: 4296-4303. In some embodiments, the endonuclease comprises a sequence at least 70%, 80%, or 90% identical to a sequence selected from the group consisting of or SEQ ID NOs: 661-668. In some embodiments, the endonuclease comprises a sequence at least 70%, 80%, or 90% identical to a sequence selected from the group consisting of or SEQ ID NOs: 2490-2498. In some embodiments, the endonuclease comprises a sequence at least 70%, 80%, or 90% identical to a sequence selected from the group consisting of SEQ ID NOs: 4304-4312. In some embodiments, the endonuclease comprises a sequence at least 70%, 80%, or 90% identical to a sequence selected from the group consisting of SEQ ID NOs: 669-677. In some embodiments, the guide RNA structure comprises a sequence at least 70%, 80%, or 90% identical to a sequence selected from the group consisting of SEQ ID NO: 5504.

In some embodiments, the endonuclease comprises a sequence at least 70%, 80%, or 90% identical to a sequence selected from the group consisting of SEQ ID NO: 2499 or SEQ ID NOs: 2499-2750. In some embodiments, the endonuclease comprises a sequence at least 70%, 80%, or 90% identical to a sequence selected from the group consisting of SEQ ID NO: 4313 or SEQ ID NOs: 4313-4564. In some embodiments, the endonuclease comprises at least 1, at least 2, at least 3, at least 4, or at least 5 peptide motifs selected from the group consisting of SEQ ID NOs: 5650-5667. In some embodiments, the endonuclease comprises a sequence at least 70%, 80%, or 90% identical to a sequence selected from the group consisting of SEQ ID NO: 678 or SEQ ID NOs: 678-929. In some embodiments, the guide RNA structure comprises a sequence at least 70%, 80%, or 90% identical to SEQ ID NO: 5469 or SEQ ID NO: 5505. In some embodiments, the endonuclease is configured to binding to a PAM comprising SEQ ID NOs: 5520 or SEQ ID NOs: 5535. In some embodiments: (a) the endonuclease comprises a sequence at least 70%, 80%, or 90% identical to SEQ ID NO: 2499; (b) the guide RNA structure comprises a sequence at least 70%, 80%, or 90% identical to SEQ ID NO: 5469 or SEQ ID NO: 5505; and (c) the endonuclease is configured to binding to a PAM comprising SEQ ID NO: 5520 or SEQ ID NO: 5535.

In some embodiments, the endonuclease comprises a sequence at least 70%, 80%, or 90% identical to a sequence selected from the group consisting of SEQ ID NO: 2751 or SEQ ID NOs: 2751-2913. In some embodiments, the endonuclease comprises a sequence at least 70%, 80%, or 90% identical to a sequence selected from the group consisting of SEQ ID NO: 4565 or SEQ ID NOs: 4565-4727. In some embodiments, the endonuclease comprises at least 1, at least 2, at least 3, at least 4, or at least 5 peptide motifs selected from the group consisting of SEQ ID NOs: 5668-5678. In some embodiments, the endonuclease comprises a sequence at least 70%, 80%, or 90% identical to a sequence selected from the group consisting of SEQ ID NO: 930 or SEQ ID NOs: 930-1092. In some embodiments, the guide RNA structure comprises a sequence at least 70%, 80%, or 90% identical to SEQ ID NO: 5470 or SEQ ID NOs: 5506. In some embodiments, the endonuclease is configured to binding to a PAM comprising a sequence selected from the group consisting of SEQ ID NOs: 5521 or SEQ ID NOs: 5536. In some embodiments: (a) the endonuclease comprises a sequence at least 70%, 80%, or 90% identical to SEQ ID NO: 2751; (b) the guide RNA structure comprises a sequence at least 70%, 80%, or 90% identical to SEQ ID NO: 5470 or SEQ ID NO: 5506; and (c) the endonuclease is configured to binding to a PAM comprising SEQ ID NO: 5521 or SEQ ID NO: 5536.

In some embodiments, the endonuclease comprises a sequence at least 70%, 80%, or 90% identical to a sequence selected from the group consisting of SEQ ID NO: 2914 or SEQ ID NOs: 2914-3174. In some embodiments, the endo-nuclease comprises a sequence at least 70%, 80%, or 90% identical to a sequence selected from the group consisting of SEQ ID NO: 4728 or SEQ ID NOs: 4728-4988. In some embodiments, the endonuclease comprises at least 1, at least 2, or at least 3 peptide motifs selected from the group consisting of SEQ ID NOs: 5676-5678. In some embodi-ments, the endonuclease comprises a sequence at least 70%, 80%, or 90% identical to a sequence selected from the group consisting of SEQ ID NO: 1093 or SEQ ID NOs: 1093-1353. In some embodiments, the guide RNA structure comprises a sequence at least 70%, 80%, or 90% identical to a sequence selected from the group consisting of SEQ ID NO: 5471, SEQ ID NO: 5507, and SEQ ID NOs: 5540-5542. In some embodiments, the guide RNA structure comprises a tracr ribonucleic acid sequence predicted to comprise at least two hairpins comprising less than 5 base-paired ribonucle-otides. In some embodiments, the endonuclease is config-ured to binding to a PAM comprising SEQ ID NO: 5522. In some embodiments: (a) the endonuclease comprises a sequence at least 70%, 80%, or 90% identical to SEQ ID NO: 2914; (b) the guide RNA structure comprises a sequence at least 70%, 80%, or 90% identical to SEQ ID NO: 5471 or SEQ ID NO: 5507; and (c) the endonuclease is configured to binding to a PAM comprising SEQ ID NO: 5522.

In some embodiments, the endonuclease comprises a sequence at least 70%, 80%, or 90% identical to a sequence selected from the group consisting of SEQ ID NO: 3175 or SEQ ID NOs: 3175-3330. In some embodiments, the endo-nuclease comprises a sequence at least 70%, 80%, or 90% identical to a sequence selected from the group consisting of SEQ ID NO: 4989 or SEQ ID NOs: 4989-5146. In some embodiments, the endonuclease comprises at least 1, at least 2, at least 3, at least 4, or at least 5 peptide motifs selected from the group consisting of SEQ ID NOs: 5679-5686. In some embodiments, the endonuclease comprises a sequence at least 70%, 80%, or 90% identical to a sequence selected from the group consisting of SEQ ID NO: 1354 or SEQ ID NOs: 1354-1511. In some embodiments, the guide RNA structure comprises a sequence at least 70%, 80%, or 90% identical to a sequence selected from the group consisting of SEQ ID NOs: 5472 or SEQ ID NOs: 5508. In some embodiments, the endonuclease is configured to binding to a PAM comprising a sequence selected from the group consisting of SEQ ID NO: 5523 or SEQ ID NO: 5537. In some embodiments: (a) the endonuclease comprises a sequence at least 70%, 80%, or 90% identical to SEQ ID NO: 3175; (b) the guide RNA structure comprises a sequence at least 70%, 80%, or 90% identical to SEQ ID NO: 5472 or SEQ ID NO: 5508; and (c) the endonuclease is configured to binding to a PAM comprising SEQ ID NO: 5523 or SEQ ID NO: 5537.

In some embodiments, the endonuclease comprises a sequence at least 70%, 80%, or 90% identical to a sequence selected from the group consisting of SEQ ID NOs: 3331 or SEQ ID NOs: 3331-3474. In some embodiments, the endo-nuclease comprises a sequence at least 70%, 80%, or 90% identical to a sequence selected from the group consisting of SEQ ID NOs: 5147 or SEQ ID NOs: 5147-5290. In some embodiments, the endonuclease comprises at least 1, at least 2, at least 3, at least 4, or at least 5 peptide motifs selected from the group consisting of SEQ ID NOs: 5674-5675 and SEQ ID NOs: 5687-5693. In some embodiments, the endo-nuclease comprises a sequence at least 70%, 80%, or 90% identical to a sequence selected from the group consisting of SEQ ID NO: 1512 or SEQ ID NOs: 1512-1655. In some embodiments, the guide RNA structure comprises a sequence at least 70%, 80%, or 90% identical to a sequence selected from the group consisting of SEQ ID NO: 5473 or SEQ ID NO: 5509. In some embodiments, the endonuclease is configured to binding to a PAM comprising SEQ ID NO: 5524. In some embodiments: (a) the endonuclease com-prises a sequence at least 70%, 80%, or 90% identical to SEQ ID NO: 3331; (b) the guide RNA structure comprises a sequence at least 70%, 80%, or 90% identical to SEQ ID NO: 5473 or SEQ ID NO: 5509; and (c) the endonuclease is configured to binding to a PAM comprising SEQ ID NO: 5524.

In some embodiments, the endonuclease comprises a sequence at least 70%, 80%, or 90% identical to a sequence selected from the group consisting of SEQ ID NO: 3475 or SEQ ID NOs: 3475-3568. In some embodiments, the endo-nuclease comprises a sequence at least 70%, 80%, or 90% identical to a sequence selected from the group consisting of SEQ ID NO: 5291 or SEQ ID NOs: 5291-5389. In some embodiments, the endonuclease comprises at least 1, at least 2, at least 3, at least 4, or at least 5 peptide motifs selected from the group consisting of SEQ ID NOs: 5694-5699. In some embodiments, the endonuclease comprises a sequence at least 70%, 80%, or 90% identical to a sequence selected from the group consisting of SEQ ID NO: 1656 or SEQ ID NOs: 1656-1755. In some embodiments, the guide RNA structure comprises a sequence at least 70%, 80%, or 90% identical to SEQ ID NO: 5474 or SEQ ID NO: 5510. In some embodiments, the endonuclease is configured to binding to a PAM comprising SEQ ID NOs: 5525. In some embodi-ments: (a) the endonuclease comprises a sequence at least 70%, 80%, or 90% identical to SEQ ID NO: 3475; (b) the guide RNA structure comprises a sequence at least 70%, 80%, or 90% identical to SEQ ID NO: 5474 or SEQ ID NO: 5510; and (c) the endonuclease is configured to binding to a PAM comprising SEQ ID NO: 5525.

In some embodiments, the endonuclease comprises a sequence at least 70%, 80%, or 90% identical to a sequence selected from the group consisting of SEQ ID NO: 3569 or SEQ ID NOs: 3569-3637. In some embodiments, the endo-nuclease comprises a sequence at least 70%, 80%, or 90% identical to a sequence selected from the group consisting of SEQ ID NO: 5390 or SEQ ID NOs: 5390-5460. In some embodiments, the endonuclease comprises at least 1, at least 2, at least 3, at least 4, or at least 5 peptide motifs selected from the group consisting of SEQ ID NOs: 5700-5717. In some embodiments, the endonuclease comprises a sequence at least 70%, 80%, or 90% identical to a sequence selected from the group consisting of SEQ ID NO: 1756 or SEQ ID NOs: 1756-1826. In some embodiments, the guide RNA structure comprises a sequence at least 70%, 80%, or 90% identical to SEQ ID NO: 5475 or SEQ ID NOs: 5511. In some embodiments, the endonuclease is configured to binding to a PAM comprising SEQ ID NO: 5526. In some embodiments: (a) the endonuclease comprises a sequence at least 70%, 80%, or 90% identical to SEQ ID NO: 3569; (b) the guide RNA structure comprises a sequence at least 70%, 80%, or 90% identical to SEQ ID NO: 5475 or SEQ ID NO: 5511; and (c) the endonuclease is configured to binding to a PAM comprising SEQ ID NO: 5526. In some embodiments, the sequence identity is determined by a BLASTP, CLUST-ALW, MUSCLE, MAFFT, or Smith-Waterman homology search algorithm. In some embodiments, the sequence identity is determined by the BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides for an engineered guide ribonucleic acid polynucleotide comprising: (a) a DNA-targeting segment comprising a nucleotide sequence that is complementary to a target sequence in a target DNA molecule; and (b) a protein-binding segment comprising two complementary stretches of nucleotides that hybridize to form a double-stranded RNA (dsRNA) duplex, wherein the two complementary stretches of nucleotides are covalently linked to one another with intervening nucleo-tides, and wherein the engineered guide ribonucleic acid polynucleotide is configured to forming a complex with an endonuclease comprising a RuvC_III domain having at least 75% sequence identity to any one of SEQ ID NOs: 1827-3637 and targeting the complex to the target sequence of the target DNA molecule. In some embodiments, the DNA-targeting segment is positioned 5' of both of the two comple-mentary stretches of nucleotides.

In some embodiments: (a) the protein binding segment comprises a sequence having at least 70%, at least 80%, or at least 90% identity to a sequence selected from the group consisting of SEQ ID NOs: 5476-5479 or SEQ ID NOs: 5476-5489; (b) the protein binding segment comprises a sequence having at least 70%, at least 80%, or at least 90% identity to a sequence selected from the group consisting of (SEQ ID NOs: 5490-5491 or SEQ ID NOs: 5490-5494) and SEQ ID NO: 5538; (c) the protein binding segment com-prises a sequence having at least 70%, at least 80%, or at least 90% identity to a sequence selected from the group consisting of SEQ ID NOs: 5498-5499; (d) the protein binding segment comprises a sequence having at least 70%, at least 80%, or at least 90% identity to a sequence selected from the group consisting of SEQ ID NOs: 5495-5497 and SEQ ID NOs: 5500-5502; (e) the protein binding segment comprises a sequence having at least 70%, at least 80%, or at least 90% identity to SEQ ID NO: 5503; (f) the protein binding segment comprises a sequence having at least 70%, at least 80%, or at least 90% identity to SEQ ID NO: 5504; (g) the protein binding segment comprises a sequence hav-ing at least 70%, at least 80%, or at least 90% identity to SEQ ID NOs: 5505; (h) protein binding segment comprises a sequence having at least 70%, at least 80%, or at least 90% identity to SEQ ID NO: 5506; (i) protein binding segment comprises a sequence having at least 70%, at least 80%, or at least 90% identity to SEQ ID NO: 5507; (j) the protein binding segment comprises a sequence having at least 70%, at least 80%, or at least 90% identity to SEQ ID NO: 5508; (k) the protein binding segment comprises a sequence hav-ing at least 70%, at least 80%, or at least 90% identity to SEQ ID NO: 5509; (l) the protein binding segment com-prises a sequence having at least 70%, at least 80%, or at least 90% identity to SEQ ID NO: 5510; or (m) the protein binding segment comprises a sequence having at least 70%, at least 80%, or at least 90% identity to SEQ ID NO: 5511.

In some embodiments: (a) the guide ribonucleic acid polynucleotide comprises an RNA sequence comprising a hairpin comprising a stem and a loop, wherein the stem comprises at least 10, at least 12, or at least 14 base-paired ribonucleotides, and an asymmetric bulge within 4 base pairs of the loop; (b) the guide ribonucleic acid polynucle-otide comprises a tracr ribonucleic acid sequence predicted to comprise a hairpin comprising at least 8, at least 10, or at least 12 base-paired ribonucleotides; (c) the guide ribo-nucleic acid polynucleotide comprises a guide ribonucleic acid sequence predicted to comprise a hairpin with an uninterrupted base-paired region comprising at least 8 nucleotides of a guide ribonucleic acid sequence and at least 8 nucleotides of a tracr ribonucleic acid sequence, and wherein the tracr ribonucleic acid sequence comprises, from 5' to 3', a first hairpin and a second hairpin, wherein the first hairpin has a longer stem than the second hairpin; or (d) the guide ribonucleic acid polynucleotide comprises a tracr ribonucleic acid sequence predicted to comprise at least two hairpins comprising less than 5 base-paired ribonucleotides.

In some aspects, the present disclosure provides for a deoxyribonucleic acid polynucleotide encoding any of the engineered guide ribonucleic acid polynucleotides described herein.

In some aspects, the present disclosure provides for a nucleic acid comprising an engineered nucleic acid sequence optimized for expression in an organism, wherein the nucleic acid encodes a class 2, type II Cas endonuclease comprising a RuvC_III domain and an HNH domain, and wherein the endonuclease is derived from an uncultivated microorganism.

In some aspects, the present disclosure provides for a nucleic acid comprising an engineered nucleic acid sequence optimized for expression in an organism, wherein the nucleic acid encodes an endonuclease comprising a RuvC_III domain having at least 70% sequence identity to any one of SEQ ID NOs: 1827-3637. In some embodiments, the endonuclease comprises an HNH domain having at least 70% or at least 80% sequence identity to any one of SEQ ID NOs: 3638-5460. In some embodiments, the endonuclease comprises SEQ ID NOs: 5572-5591 or a variant thereof having at least 70% sequence identity thereto. In some embodiments, the endonuclease comprises a sequence encoding one or more nuclear localization sequences (NLSs) proximal to an N- or C-terminus of the endonuclease. In some embodiments, the NLS comprises a sequence selected from SEQ ID NOs: 5597-5612.

In some embodiments, the organism is prokaryotic, bac-terial, eukaryotic, fungal, plant, mammalian, rodent, or human. In some embodiments, the organism is E. coli, and: (a) the nucleic acid sequence has at least 70%, 80%, or 90% identity to a sequence selected from the group consisting of SEQ ID NOs: 5572-5575; (b) the nucleic acid sequence has at least 70%, 80%, or 90% identity to a sequence selected from the group consisting of SEQ ID NOs: 5576-5577; (c)

the nucleic acid sequence has at least 70%, 80%, or 90% identity to a sequence selected from the group consisting of SEQ ID NOs: 5578-5580; (d) the nucleic acid sequence has at least 70%, 80%, or 90% identity to SEQ ID NO: 5581; (e) the nucleic acid sequence has at least 70%, 80%, or 90% identity to SEQ ID NO: 5582; (f) the nucleic acid sequence has at least 70%, 80%, or 90% identity to SEQ ID NO: 5583; (g) the nucleic acid sequence has at least 70%, 80%, or 90% identity to SEQ ID NO: 5584; (h) the nucleic acid sequence has at least 70%, 80%, or 90% identity to SEQ ID NO: 5585; (i) the nucleic acid sequence has at least 70%, 80%, or 90% identity to SEQ ID NO: 5586; or (j) the nucleic acid sequence has at least 70%, 80%, or 90% identity to SEQ ID NO: 5587. In some embodiments, the organism is human, and: (a) the nucleic acid sequence has at least 70%, 80%, or 90% identity to SEQ ID NO: 5588 or SEQ ID NO: 5589; or (b) the nucleic acid sequence has at least 70%, 80%, or 90% identity to SEQ ID NO: 5590 or SEQ ID NO: 5591.

In some aspects, the present disclosure provides for a vector comprising a nucleic acid sequence encoding a class 2, type II Cas endonuclease comprising a RuvC_III domain and an HNH domain, wherein the endonuclease is derived from an uncultivated microorganism.

In some aspects, the present disclosure provides for a vector comprising the any of the nucleic acids described herein. In some embodiments, the vector further comprises a nucleic acid encoding an engineered guide ribonucleic acid structure configured to form a complex with the endonuclease comprising: (a) a guide ribonucleic acid sequence configured to hybridize to a target deoxyribonucleic acid sequence; and (b) a tracr ribonucleic acid sequence configured to binding to the endonuclease. In some embodiments, the vector is a plasmid, a minicircle, a CELiD, an adeno-associated virus (AAV) derived virion, or a lentivirus.

In some aspects, the present disclosure provides for a cell comprising any of the vectors described herein.

In some aspects, the present disclosure provides for a method of manufacturing an endonuclease, comprising cultivating any of the cells described herein.

In some aspects, the present disclosure provides for a method for binding, cleaving, marking, or modifying a double-stranded deoxyribonucleic acid polynucleotide, comprising: (a) contacting the double-stranded deoxyribonucleic acid polynucleotide with a class 2, type II Cas endonuclease in complex with an engineered guide ribonucleic acid structure configured to bind to the endonuclease and the double-stranded deoxyribonucleic acid polynucleotide; (b) wherein the double-stranded deoxyribonucleic acid polynucleotide comprises a protospacer adjacent motif (PAM); and (c) wherein the PAM comprises a sequence selected from the group consisting of SEQ ID NOs: 5512-5526 or SEQ ID NOs: 5527-5537. In some embodiments, the double-stranded deoxyribonucleic acid polynucleotide comprises a first strand comprising a sequence complementary to a sequence of the engineered guide ribonucleic acid structure and a second strand comprising the PAM. In some embodiments, the PAM is directly adjacent to the 3' end of the sequence complementary to the sequence of the engineered guide ribonucleic acid structure.

In some embodiments, the class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some embodiments: (a) the PAM comprises a sequence selected from the group consisting of SEQ ID NOs: 5512-5515 and SEQ ID NOs: 5527-5530; (b) the PAM comprises SEQ ID NO: 5516 or SEQ ID NO: 5531; (c) the PAM comprises SEQ ID NO: 5539; (d) the PAM comprises SEQ ID NO: 5517 or SEQ ID NO: 5518; (e) the PAM comprises SEQ ID NO: 5519; (f) the PAM comprises SEQ ID NO: 5520 or SEQ ID NO: 5535; (g) the PAM comprises SEQ ID NO: 5521 or SEQ ID NO: 5536; (h) the PAM comprises SEQ ID NO: 5522; (i) the PAM comprises SEQ ID NO: 5523 or SEQ ID NO: 5537; (j) the PAM comprises SEQ ID NO: 5524; (k) the PAM comprises SEQ ID NO: 5525; or (1) the PAM comprises SEQ ID NO: 5526.

In some aspects, the present disclosure provides for a method of modifying a target nucleic acid locus, the method comprising delivering to the target nucleic acid locus any of the engineered nuclease systems described herein, wherein the endonuclease is configured to form a complex with the engineered guide ribonucleic acid structure, and wherein the complex is configured such that upon binding of the complex to the target nucleic acid locus, the complex modifies the target nucleic locus. In some embodiments, modifying the target nucleic acid locus comprises binding, nicking, cleaving, or marking the target nucleic acid locus. In some embodiments, the target nucleic acid locus comprises deoxyribonucleic acid (DNA) or ribonucleic acid (RNA). In some embodiments, the target nucleic acid comprises genomic DNA, viral DNA, viral RNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell.

In some embodiments, delivering the engineered nuclease system to the target nucleic acid locus comprises delivering nucleic acid comprising: (i) an engineered nucleic acid sequence optimized for expression in an organism, wherein said nucleic acid encodes a class 2, type II Cas endonuclease comprising a RuvC III domain and an HNH domain, and wherein said endonuclease is derived from an uncultivated microorganism or (ii) an engineered nucleic acid sequence optimized for expression in an organism, wherein said nucleic acid encodes an endonuclease comprising a RuvC III domain having at least 70% sequence identity to any one of SEQ ID NOs: 1827-3637, wherein the endonuclease optionally: (a) comprises an HNH domain having at least 70% or at least 80% sequence identity to any one of SEQ ID NOs: 3638-5460; (b) comprises SEQ ID NOs: 5572-5591 or a variant thereof having at least 70% sequence identity thereto; (c) comprises a sequence encoding one or more nuclear localization sequences (NLSs) proximal to an N- or C-terminus of said endonuclease; or (d) comprises a sequence encoding one or more nuclear localization sequences (NLSs) proximal to an N- or C-terminus of said endonuclease wherein said NLS comprises a sequence selected from SEQ ID NOs: 5597-5612. In some embodiments, delivering the engineered nuclease system to the target nucleic acid locus comprises delivering a nucleic acid comprising an open reading frame encoding the endonuclease. In some embodiments, the nucleic acid comprises a promoter to which the open reading frame encoding the endonuclease is operably linked. In some embodiments, the engineered nuclease system to the target nucleic acid locus comprises delivering a capped mRNA containing the open reading frame encoding the endonuclease. In some embodiments, the engineered nuclease system to the target nucleic acid locus comprises delivering a translated polypeptide. In some embodiments, the engineered nuclease system to the target nucleic acid locus comprises delivering a deoxyribonucleic acid (DNA) encoding the engineered guide ribonucleic acid structure operably linked to a ribonucleic acid (RNA) pol III promoter. In some embodiments, the endonuclease induces a single-stranded break or a double-stranded break at or proximal to the target locus.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

FIG. 2 depicts the architecture of a natural Class2/Type II crRNA/tracrRNA pair, compared to a hybrid sgRNA wherein both are joined.

FIG. 11 depicts in cell cleavage of *E. coli* genomic DNA using MG1-4 along with its corresponding sgRNA. Shown are dilution series of cells transformed with MG1-4 along with target or non-target spacer (top); bottom panel shows the data quantitated, where the left bar represents non-target sgRNA and the right bar represents target sgRNA.

FIG. 12 depicts in cell indel formation generated by transfection of HEK cells with MG1-4 or MG1-6 constructs described in Example 11 alongside their corresponding sgRNAs containing various different targeting sequences targeting various locations in the human genome.

FIG. 13 depicts vitro cleavage of DNA by MG3-6 in complex with its corresponding sgRNA containing targeting sequences of varying lengths.

FIG. 14 depicts in cell cleavage of *E. coli* genomic DNA using MG3-7 along with its corresponding sgRNA. Shown are dilution series of cells transformed with MG3-7 along with target or non-target spacer (top); bottom panel shows the data quantitated, where the left bar represents non-target sgRNA and the right bar represents target sgRNA.

FIGS. 17, 18, 19, and 20 depict agarose gels showing the results of PAM vector library cleavage in the presence of TXTL extracts containing various MG family nucleases and their corresponding tracrRNAs or sgRNAs.

FIGS. 27, 28, 29, 30, 31, 32 and 33 depict seqLogo representations of PAM sequences derived via NGS as described herein (e.g. as described in Example 6).

FIG. 34 depicts in cell cleavage of *E. coli* genomic DNA using MG2-7 along with its corresponding sgRNA. Shown are dilution series of cells transformed with MG2-7 along with target or non-target spacer (top); bottom panel shows the data quantitated, where the right bar represents non-target sgRNA and the left bar represents target sgRNA.

FIG. 35 depicts in cell cleavage of *E. coli* genomic DNA using MG14-1 along with its corresponding sgRNA. Shown are dilution series of cells transformed with MG14-1 along with target or non-target spacer (top); bottom panel shows the data quantitated, where the right bar represents non-target sgRNA and the left bar represents target sgRNA.

FIG. 36 depicts in cell cleavage of *E. coli* genomic DNA using MG15-1 along with its corresponding sgRNA. Shown are dilution series of cells transformed with MG15-1 along with target or non-target spacer (top); bottom panel shows the data quantitated, where the right bar represents non-target sgRNA and the left bar represents target sgRNA.

BRIEF DESCRIPTION OF THE SEQUENCE LISTING

Figure 1:
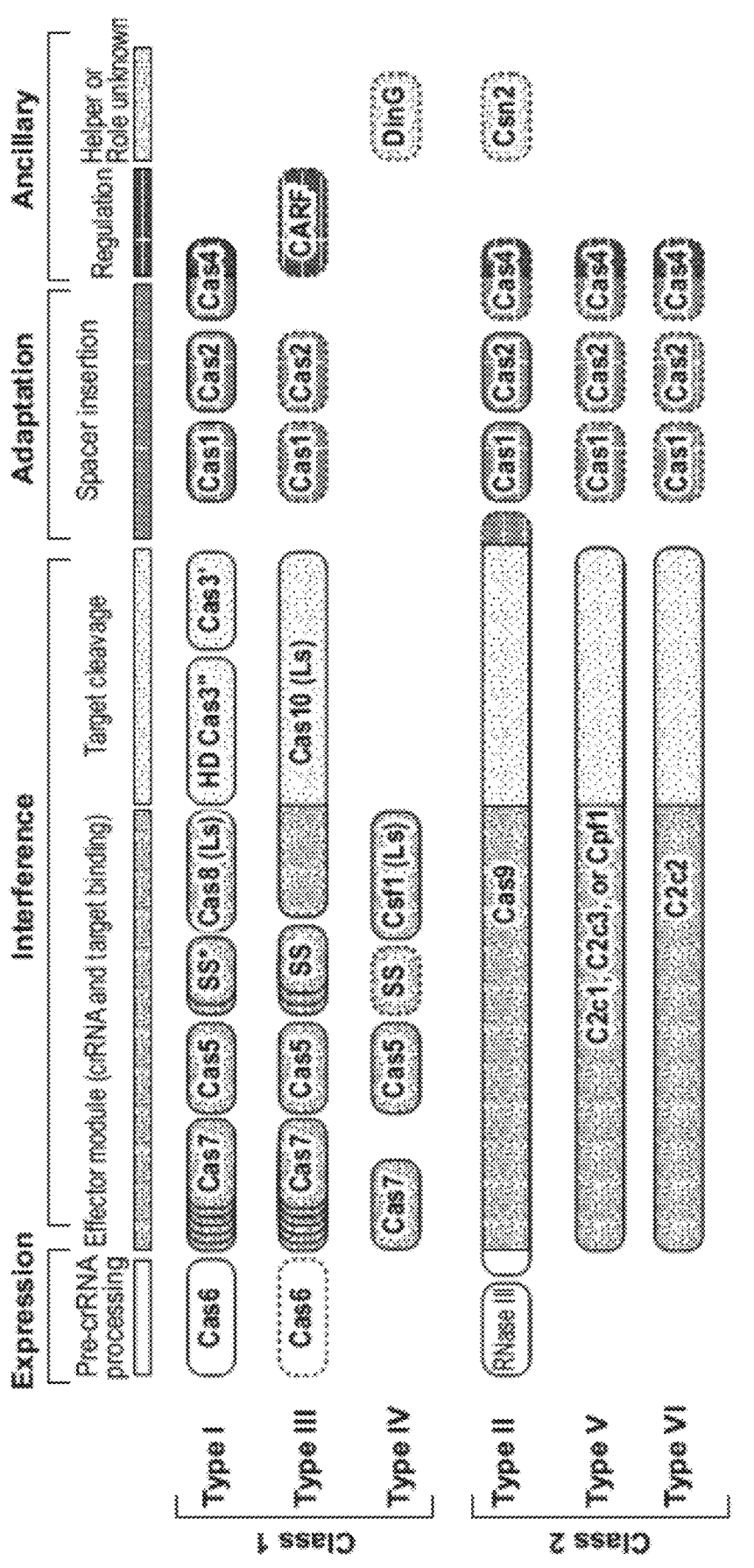
FIG. 1 depicts typical organizations of CRISPR/Cas loci of different classes and types.
Figure 3:
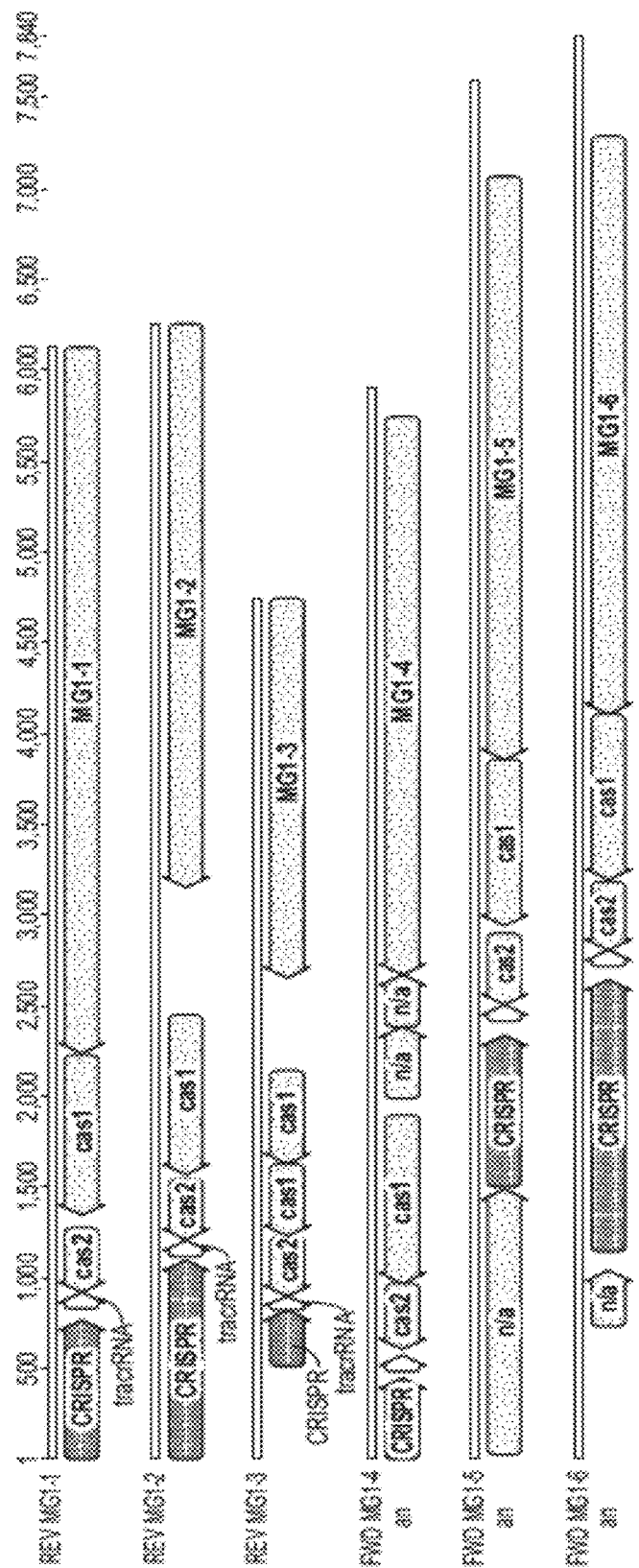
FIG. 3 depicts schematics showing organization of CRISPR loci encoding enzymes from the MG1 family.
Figure 4:
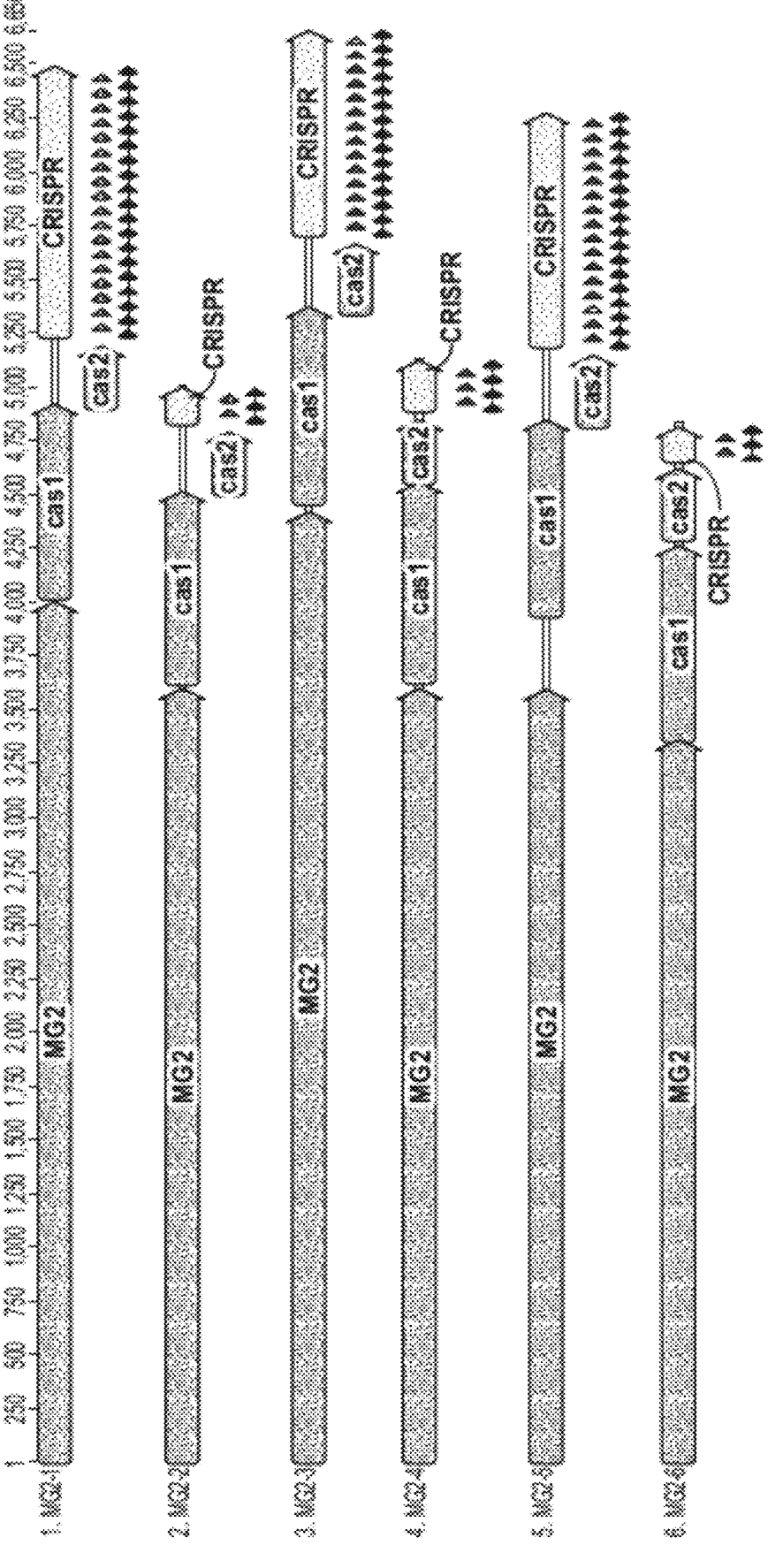
FIG. 4 depicts schematics showing organization of CRISPR loci encoding enzymes from the MG2 family.
Figure 5:
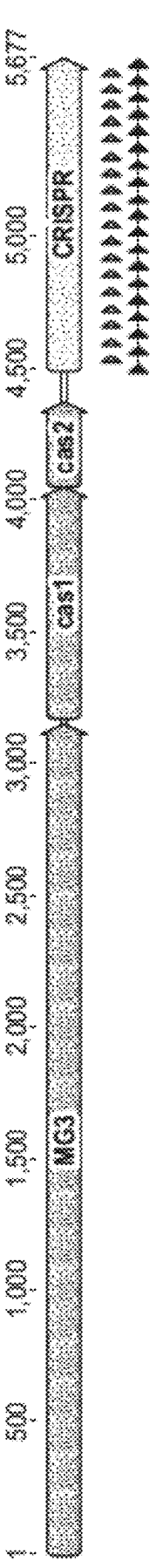
FIG. 5 depicts schematics showing organization of CRISPR loci encoding enzymes from the MG3 family.
Figure 6A:
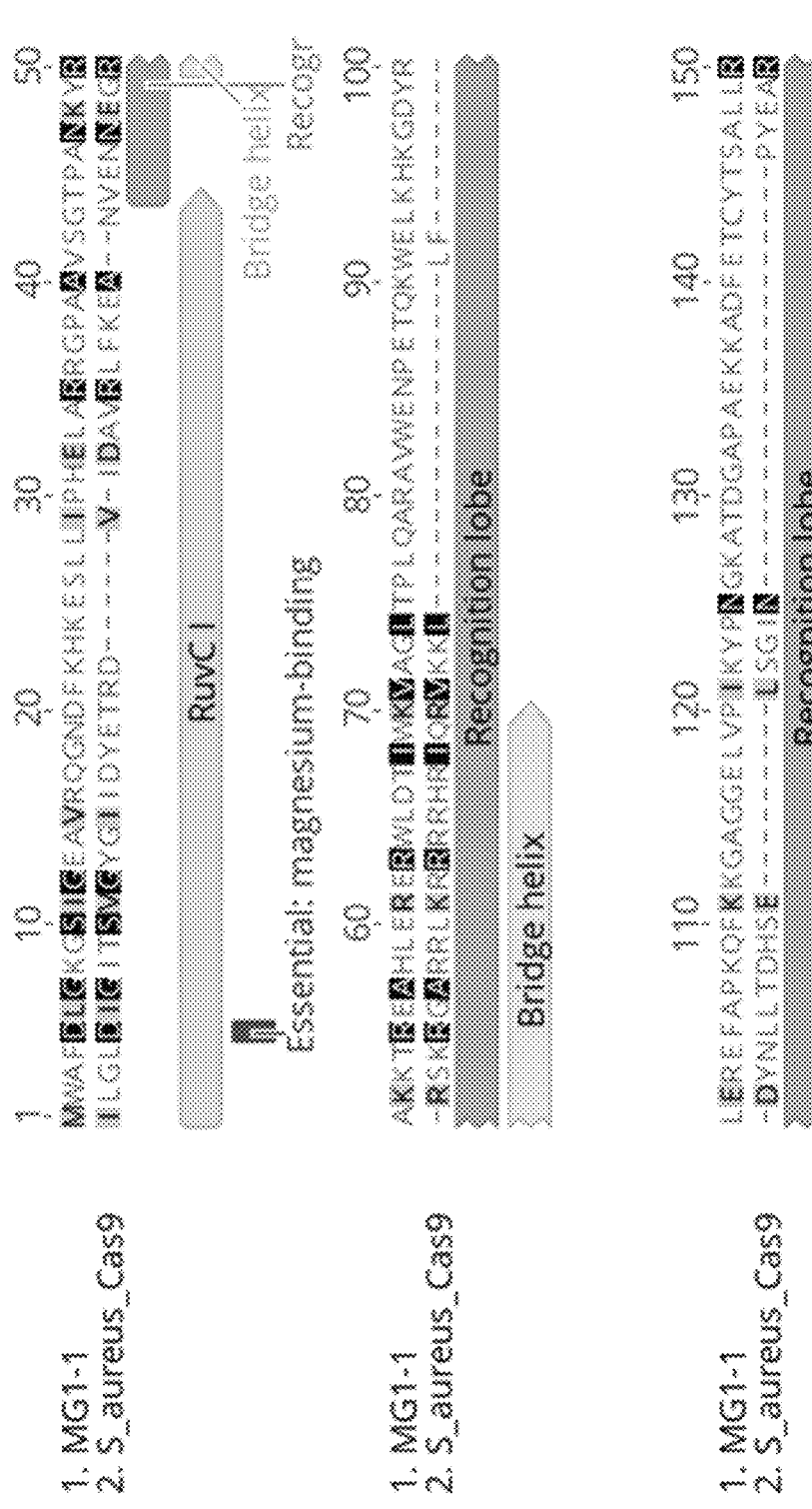
FIG. 6A-6E depicts a structure-based alignment of an enzyme of the present disclosure (MG1-1) versus Cas9 from *Staphylococcus aureus* (SEQ ID NO:5613).
Figure 6A:
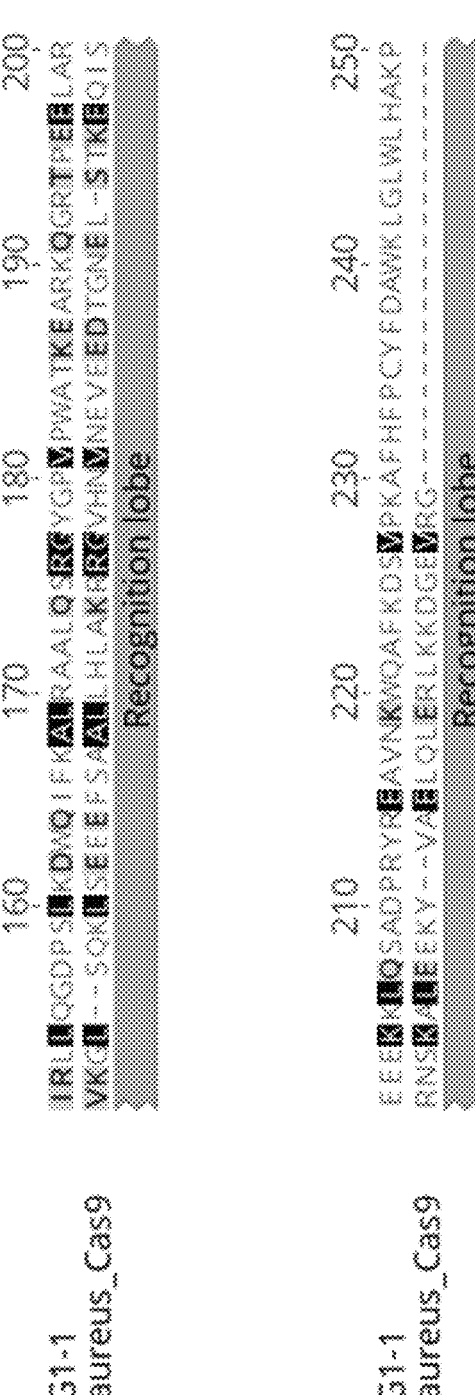
Figure 6B:
Figure 6B:
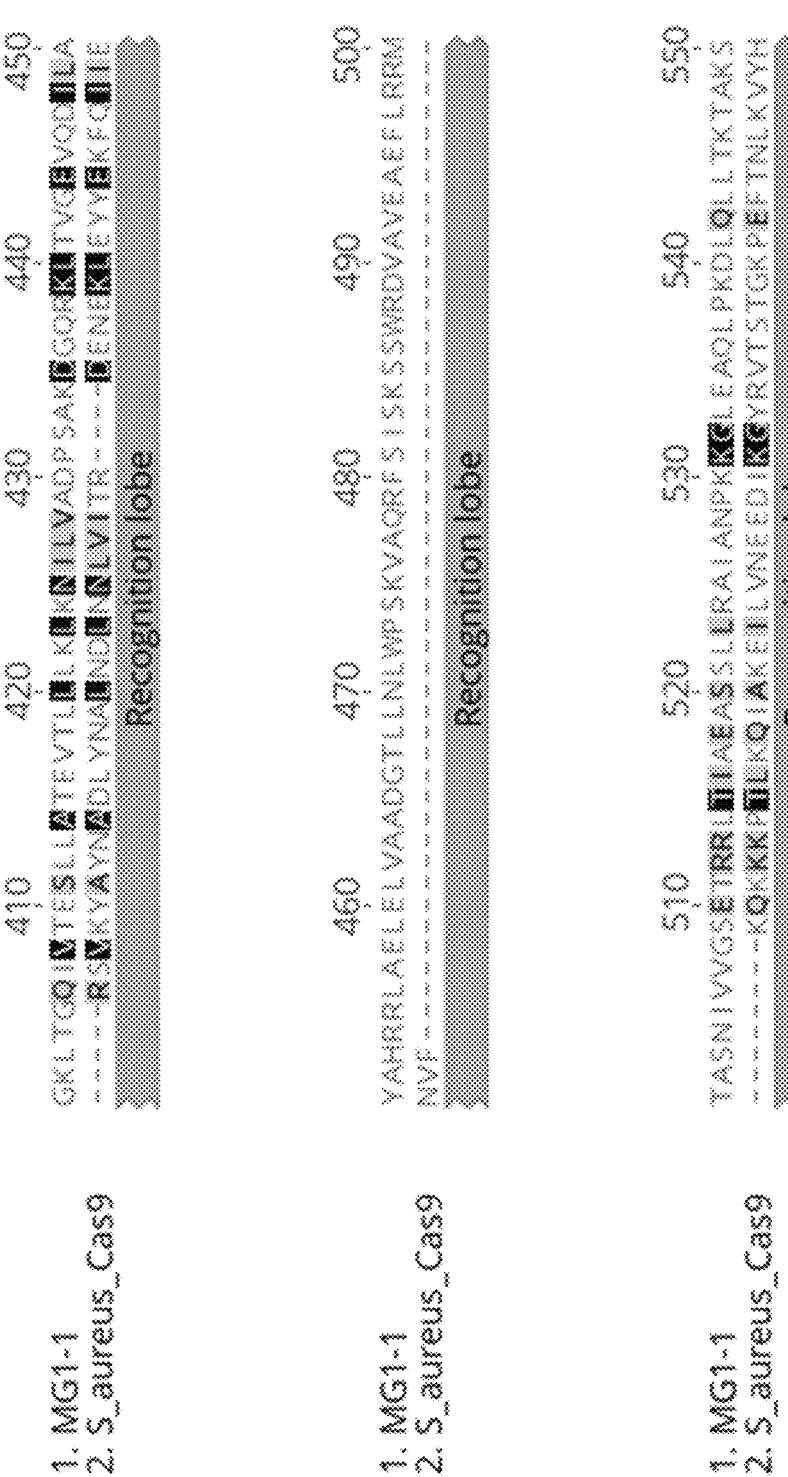
Figure 6C:
Figure 6C:
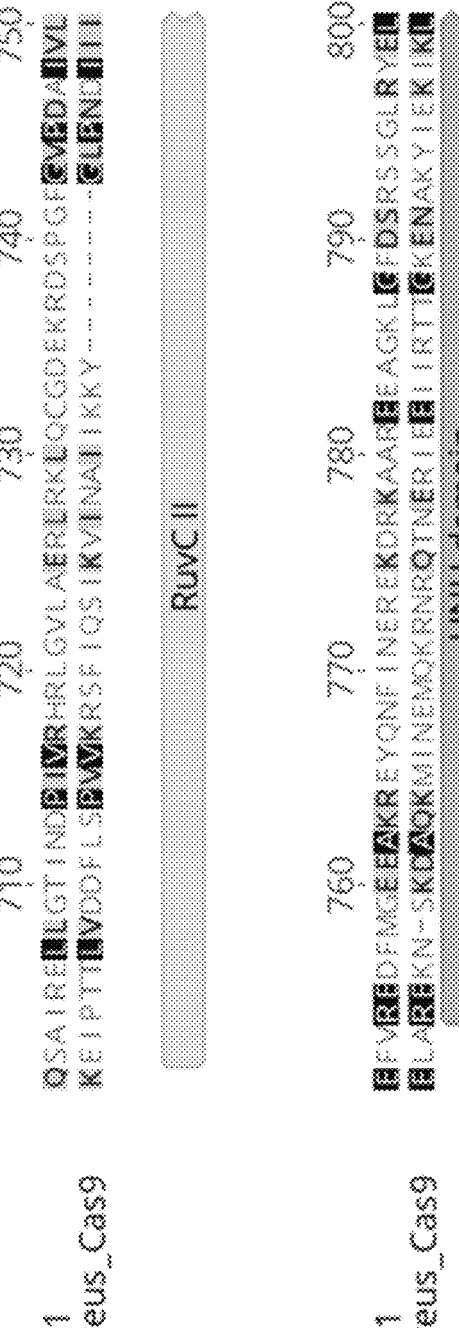
Figure 6D:
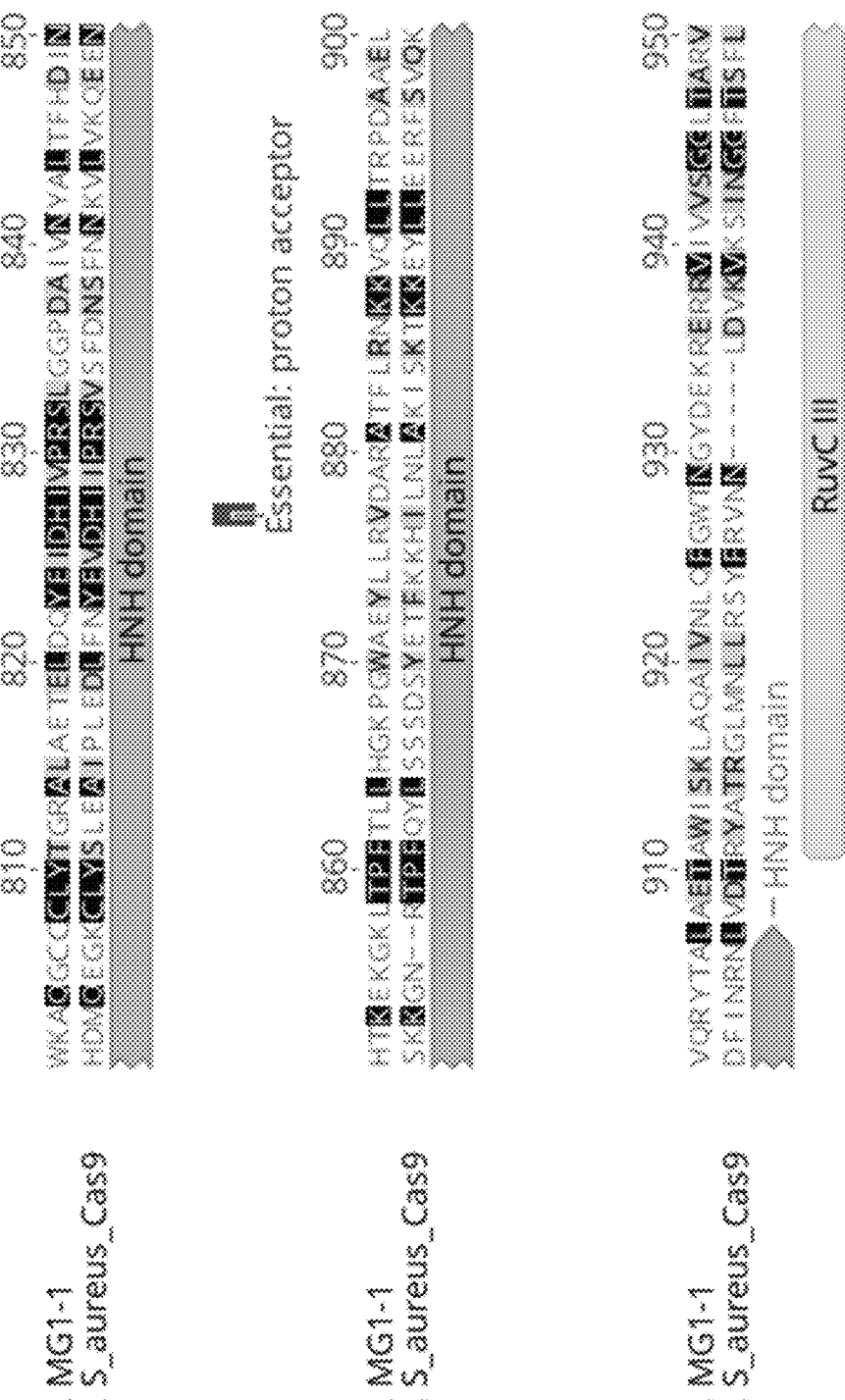
Figure 6D:
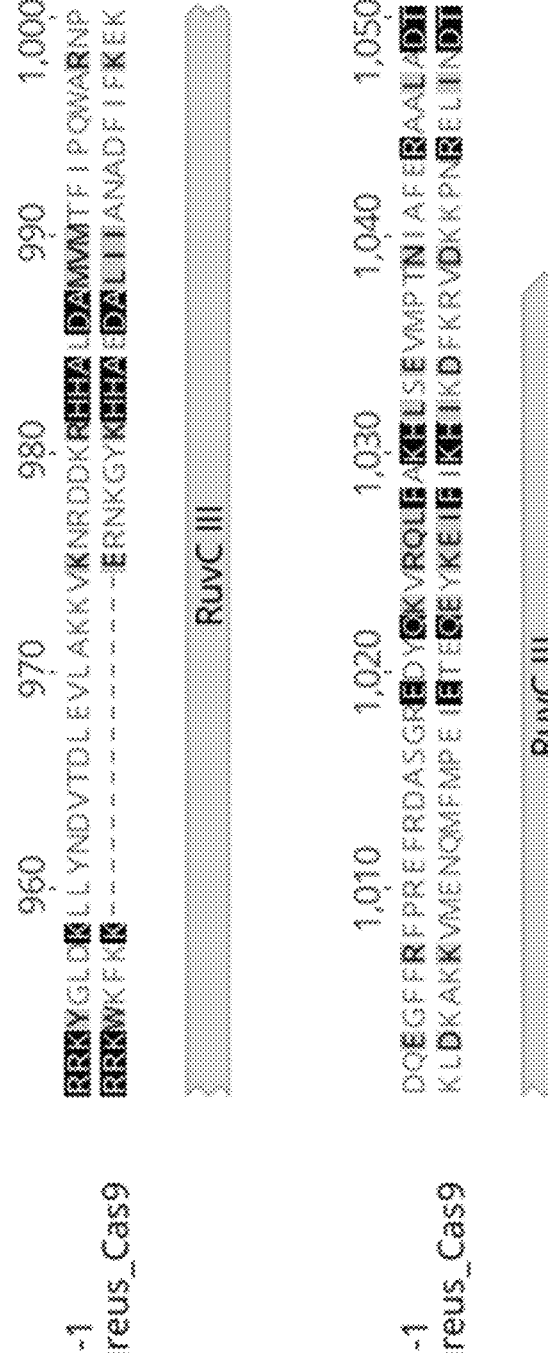
Figure 6E:
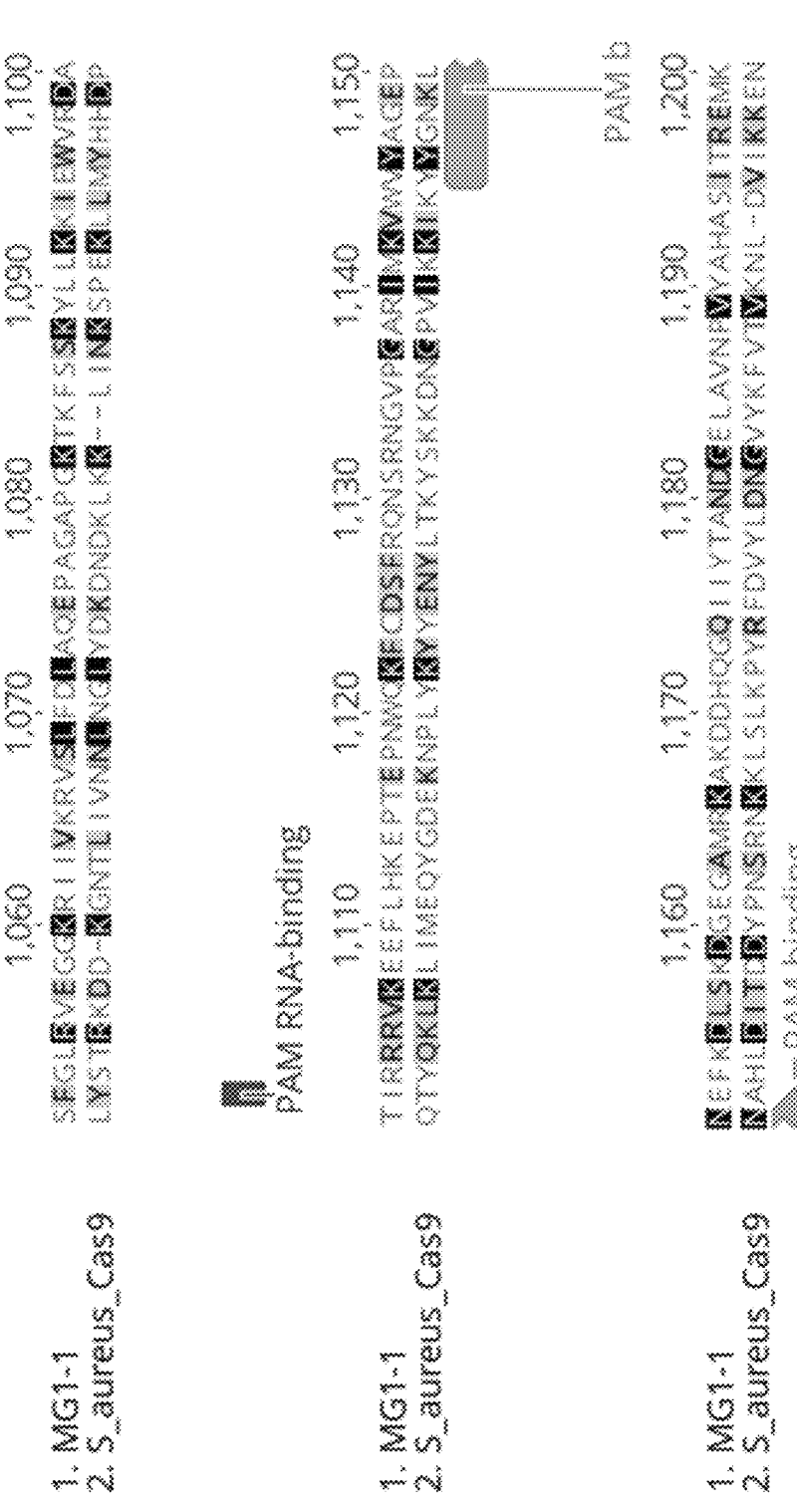
Figure 6E:
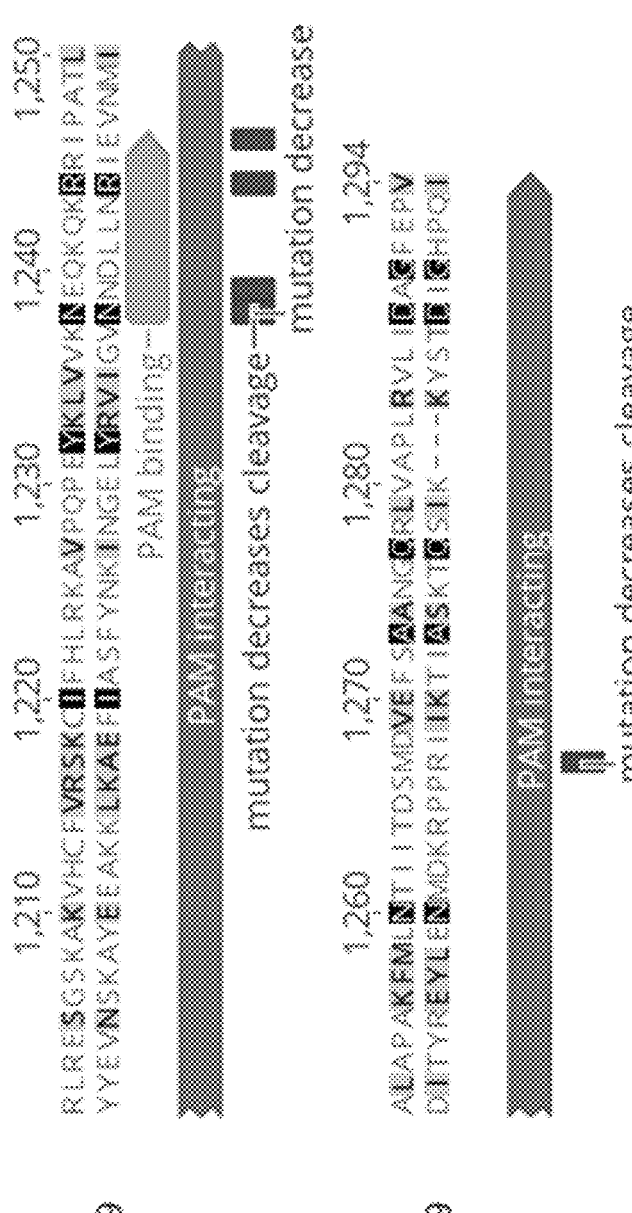
Figure 7A:
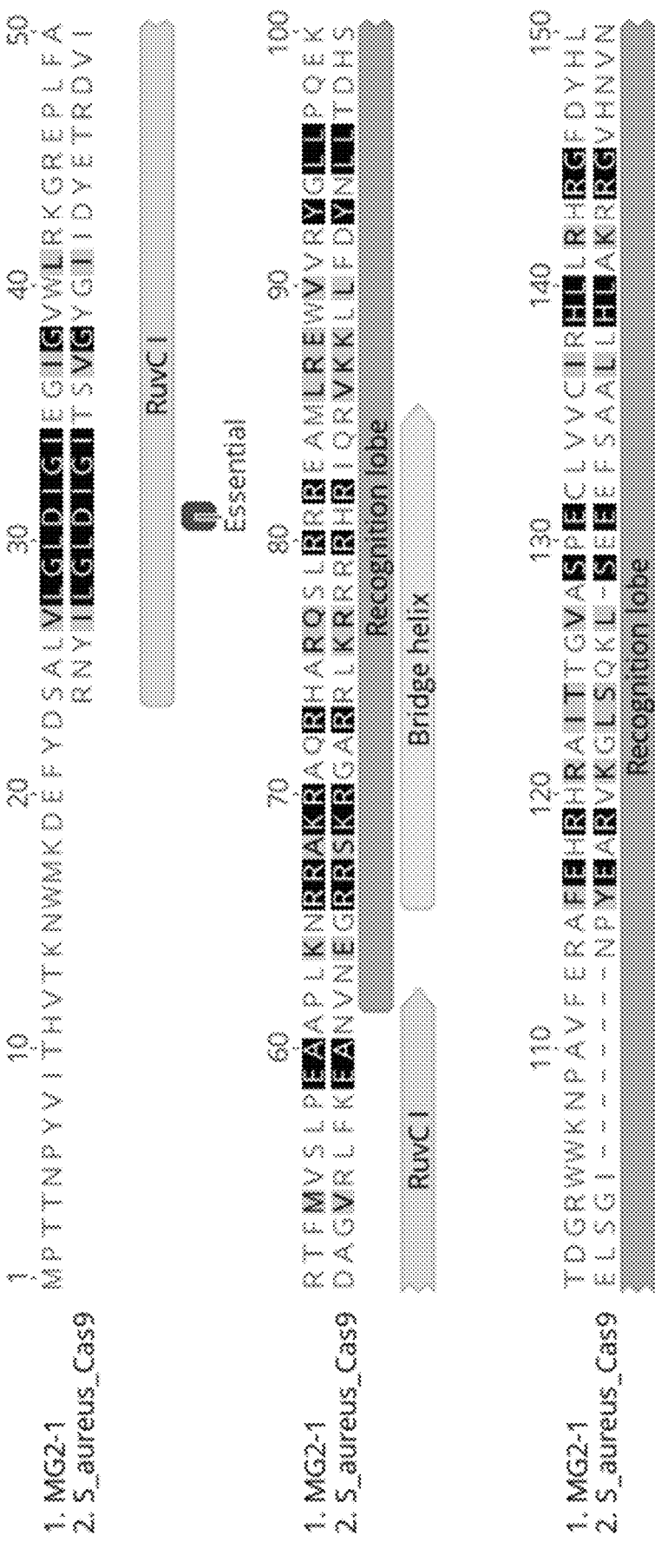
FIG. 7A-7D depicts a structure-based alignment of an enzyme of the present disclosure (MG2-1) versus Cas9 from *Staphylococcus aureus* (SEQ ID NO:5613).
Figure 7B:
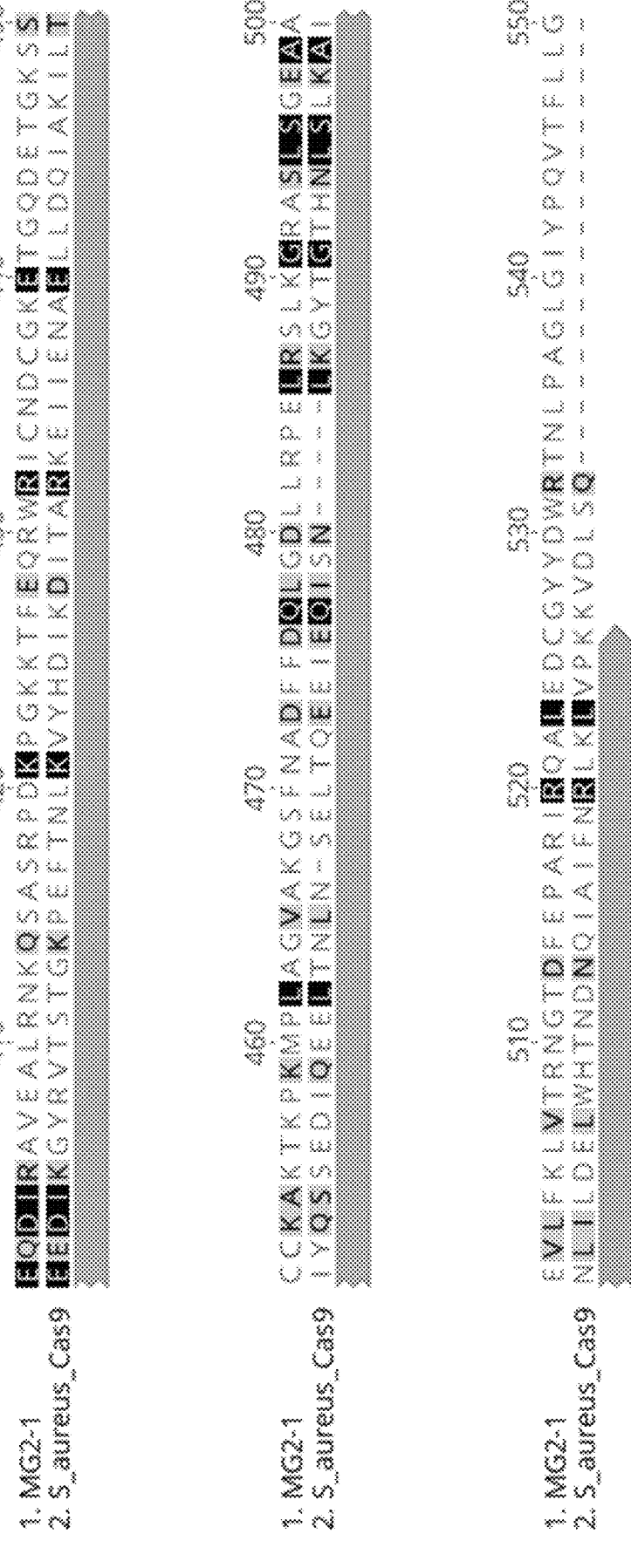
Figure 7C:
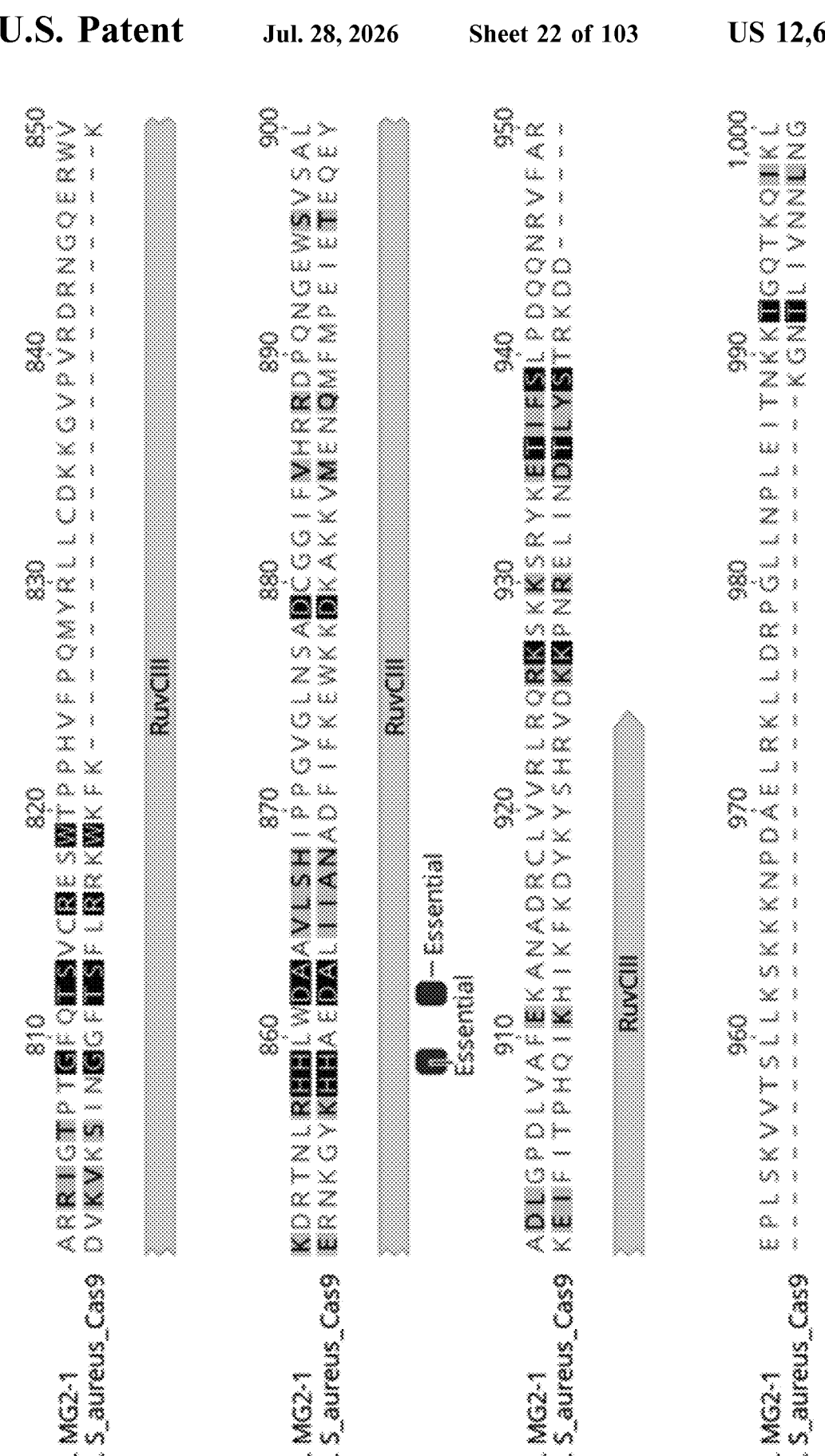
Figure 7C:
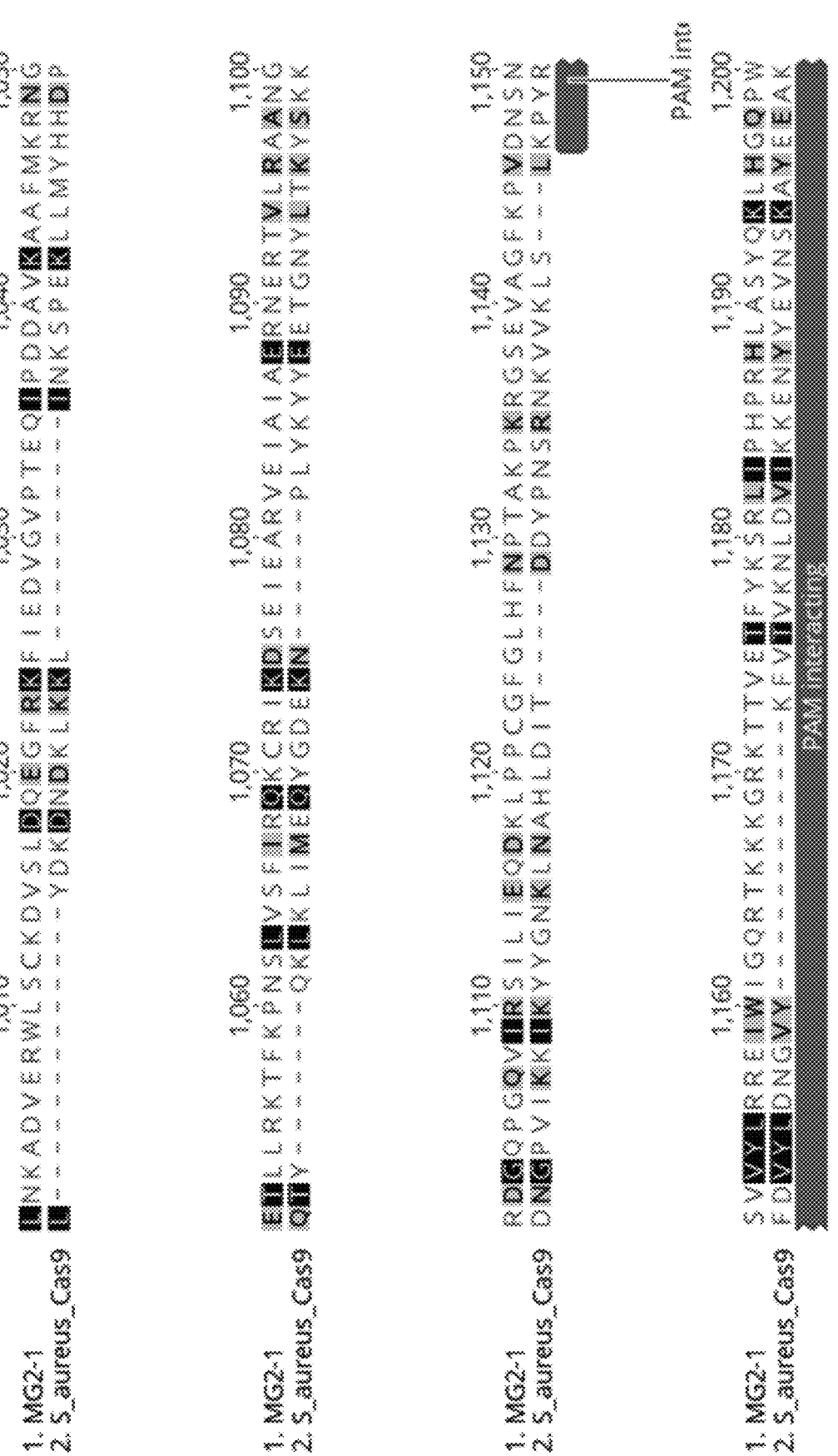
Figure 7D:
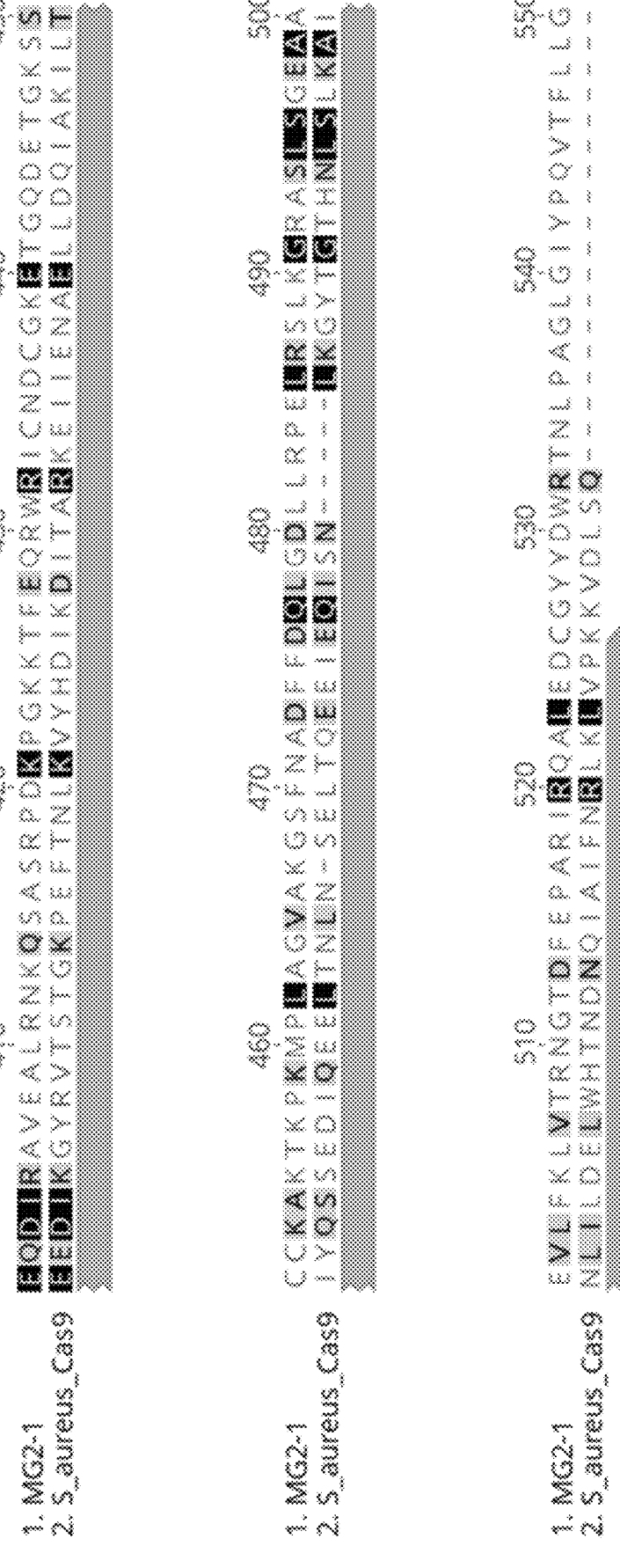
Figure 8A:
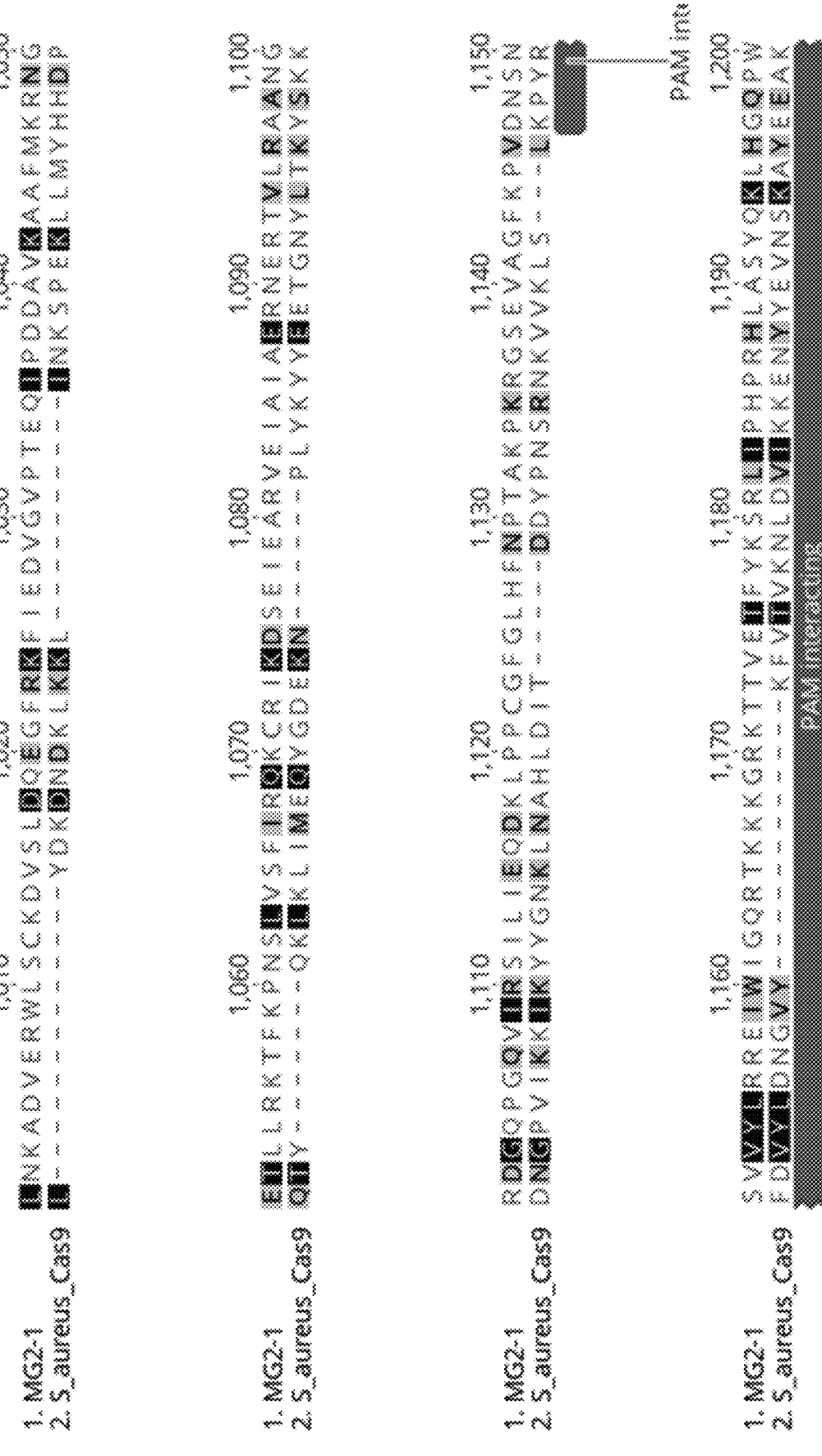
FIG. 8A-8C depicts a structure-based alignment of an enzyme of the present disclosure (MG3-1) versus Cas9 from *Actinomyces naeslundii* (SEQ ID NO: 5614).
Figure 8B:
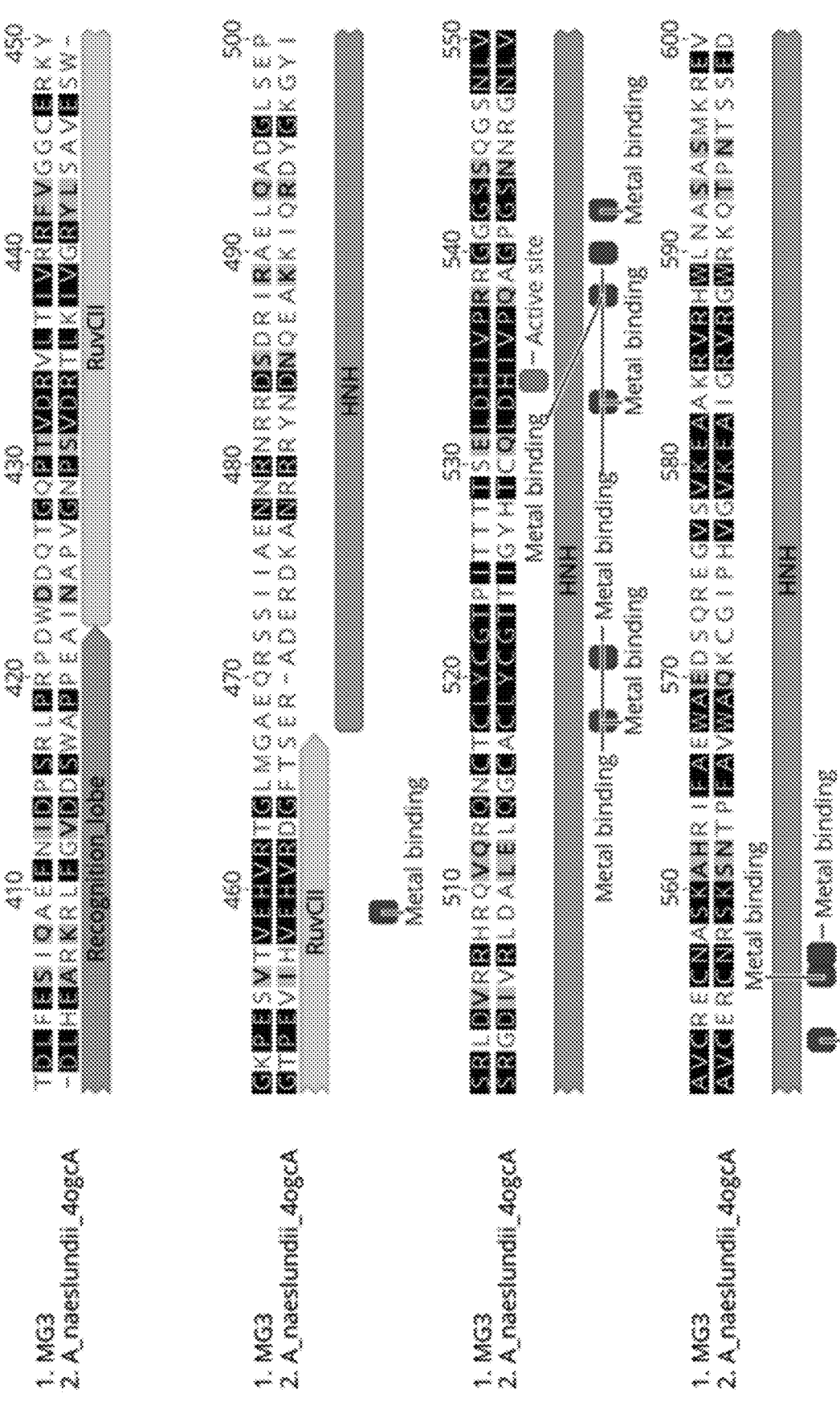
Figure 8B:
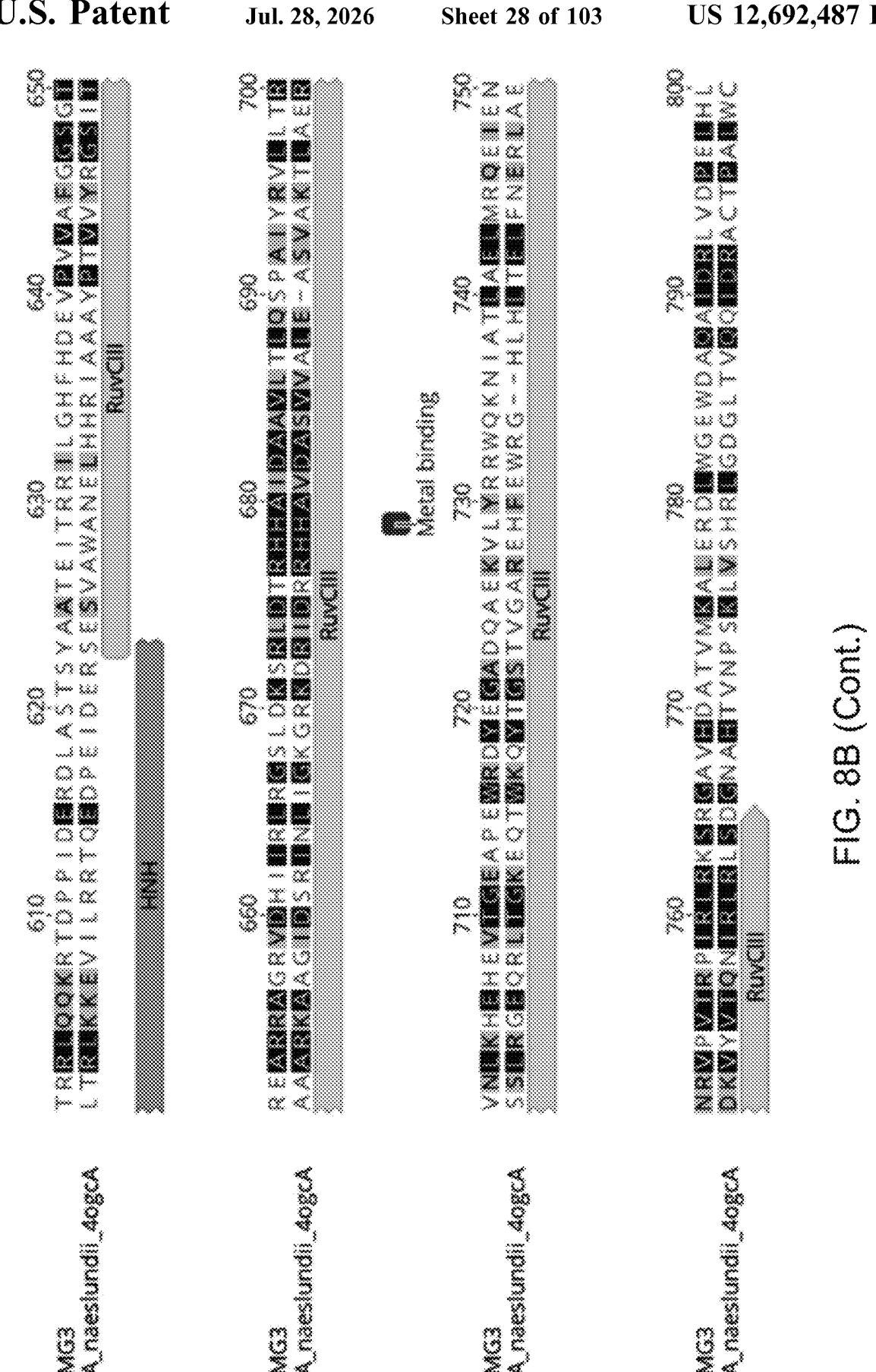
Figure 8C:
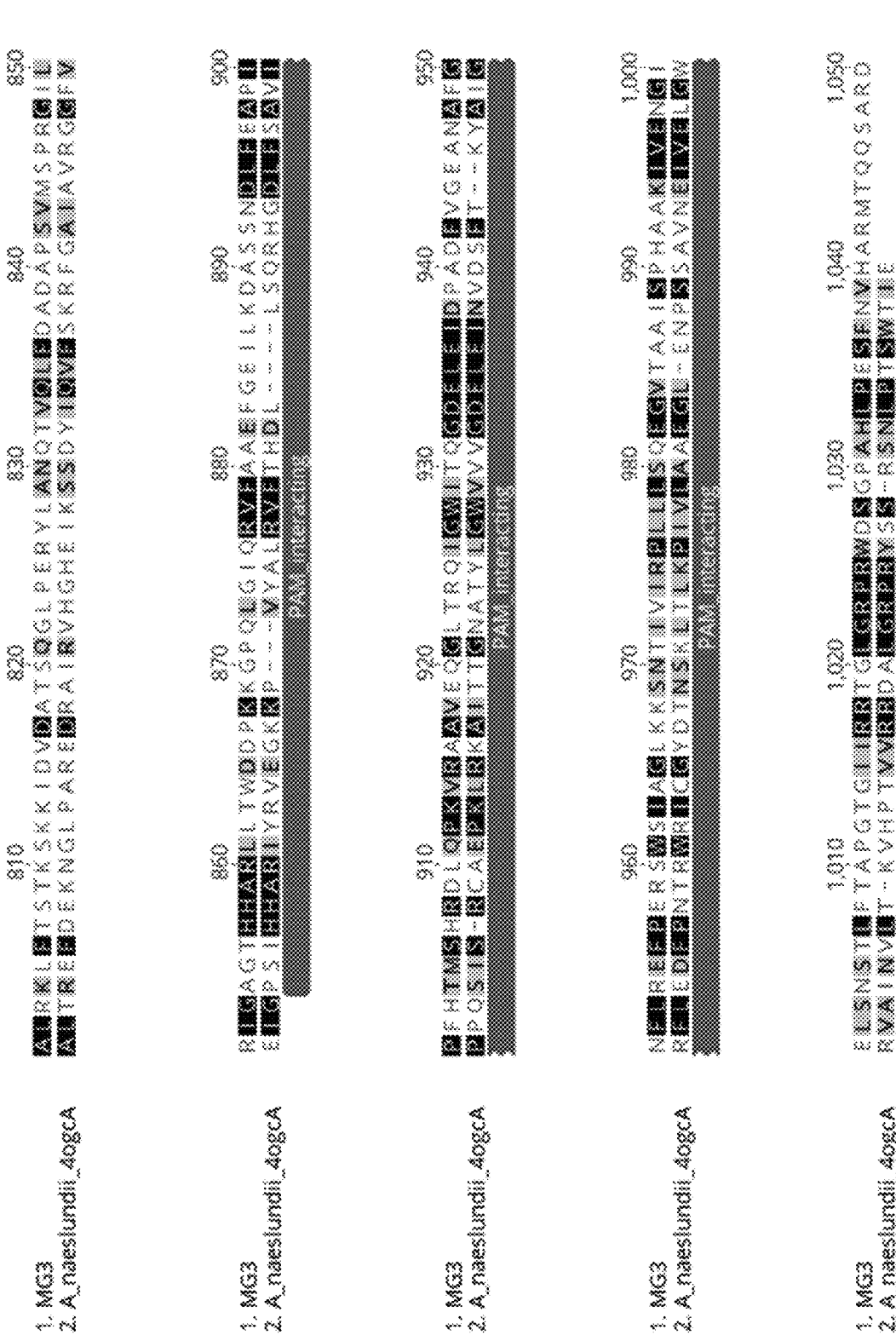
Figure 9A:
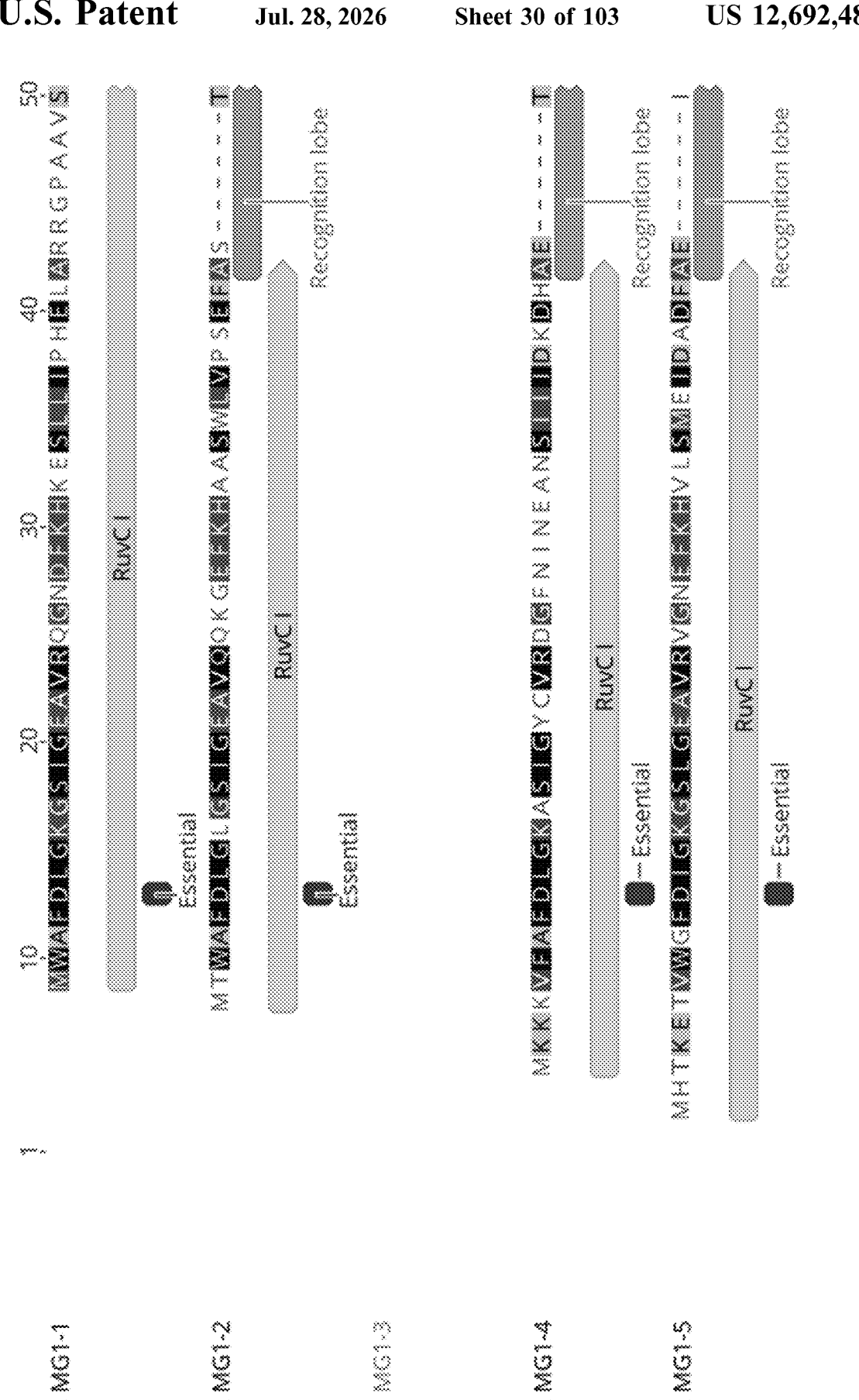
FIGS. 9A-90 depicts a structure-based alignment of MG1 family enzymes MG1-1 through MG1-6 (SEQ ID NOs: 5, 6, 9, 1, 2, and 3).
Figure 9B:
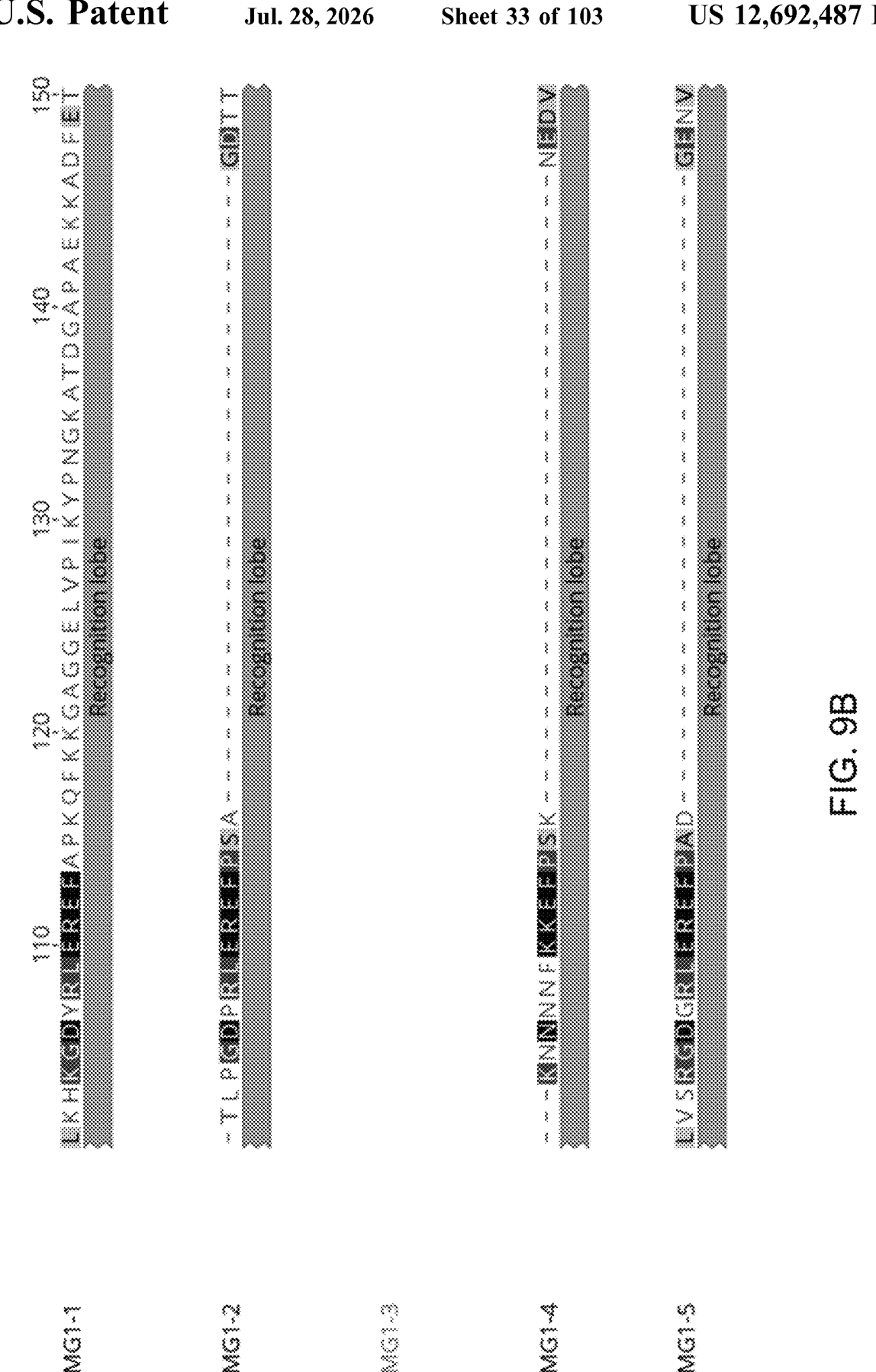
Figure 9C:
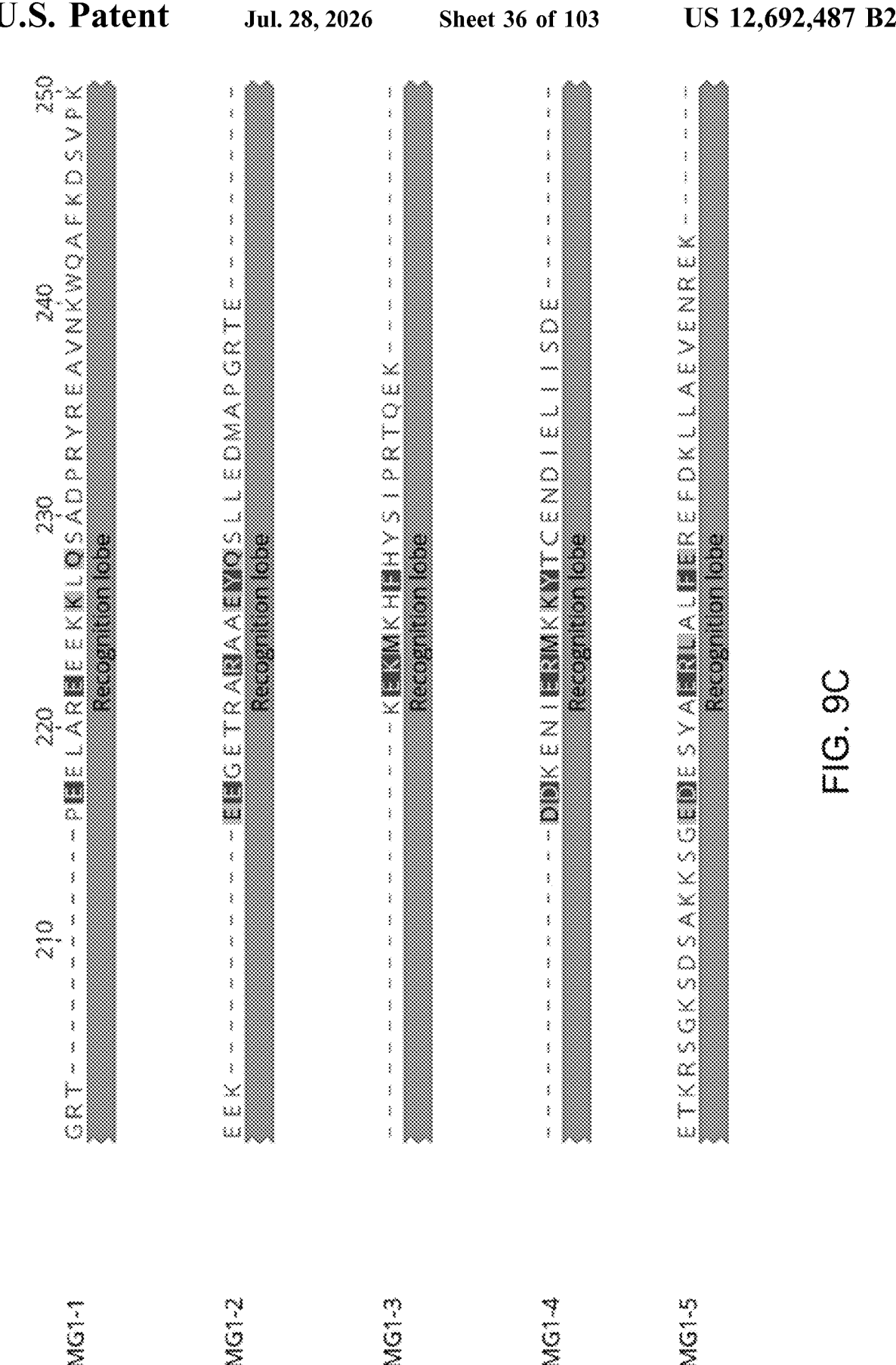
Figure 9D:
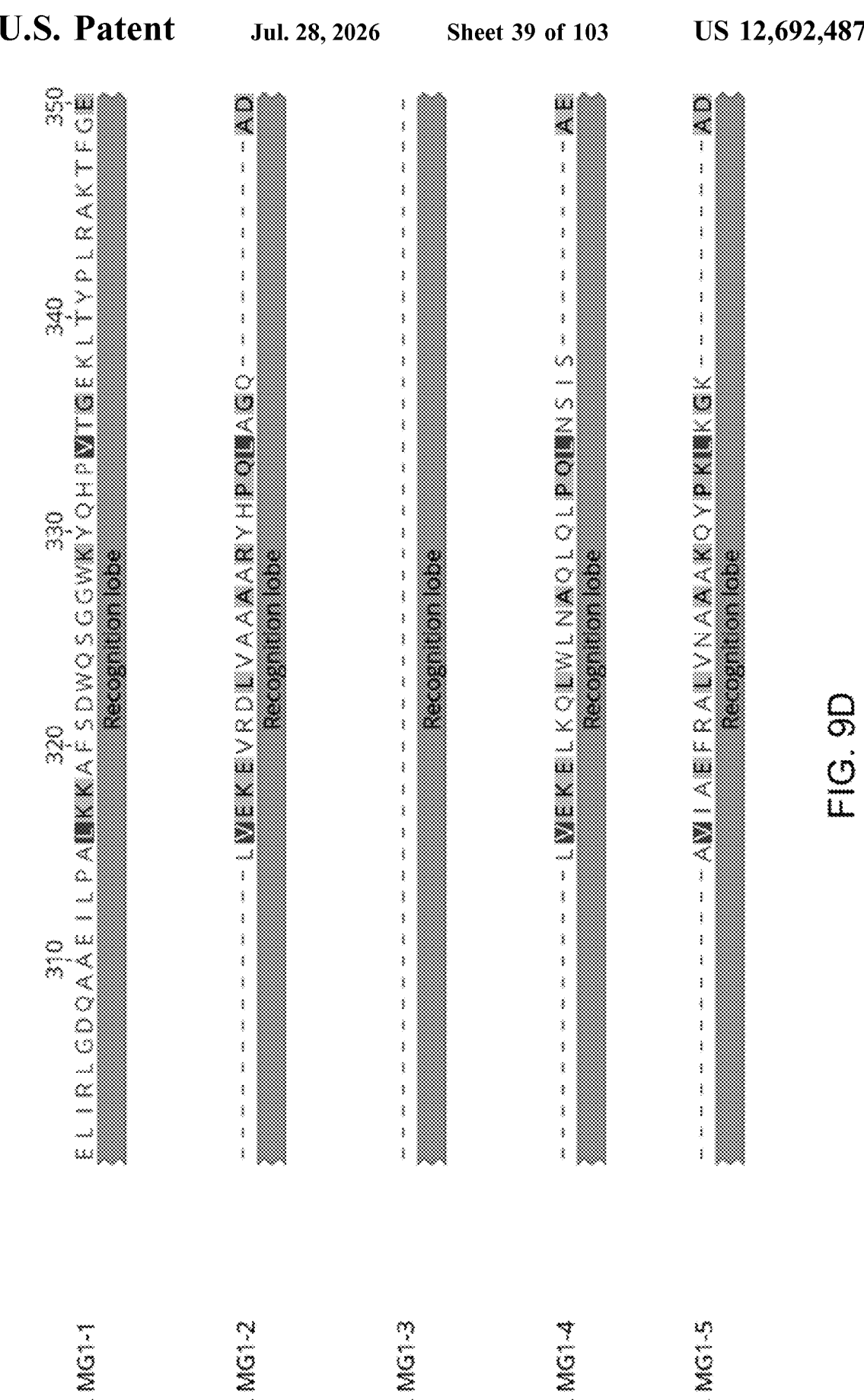
Figure 9E:
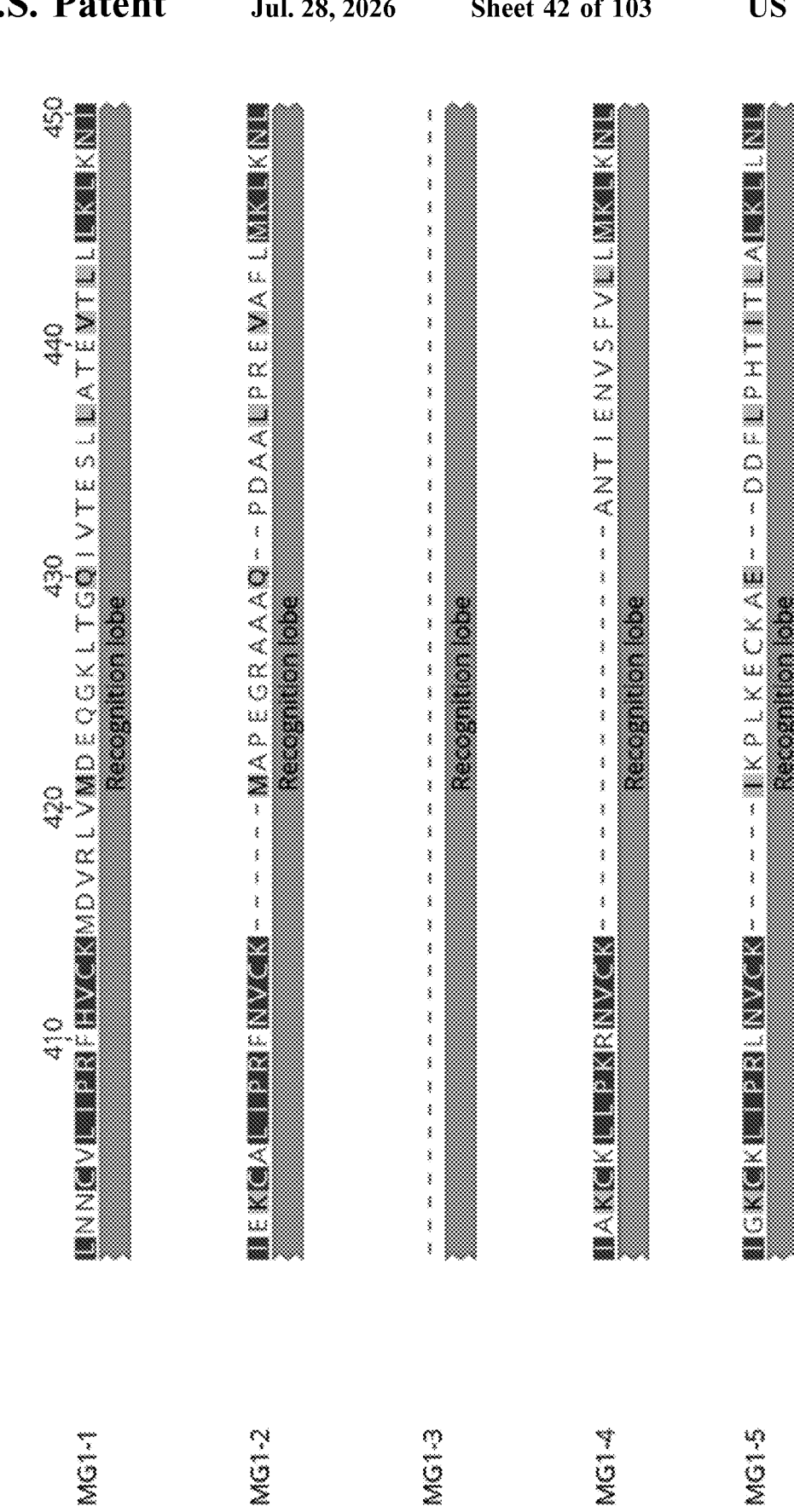
Figure 9F:
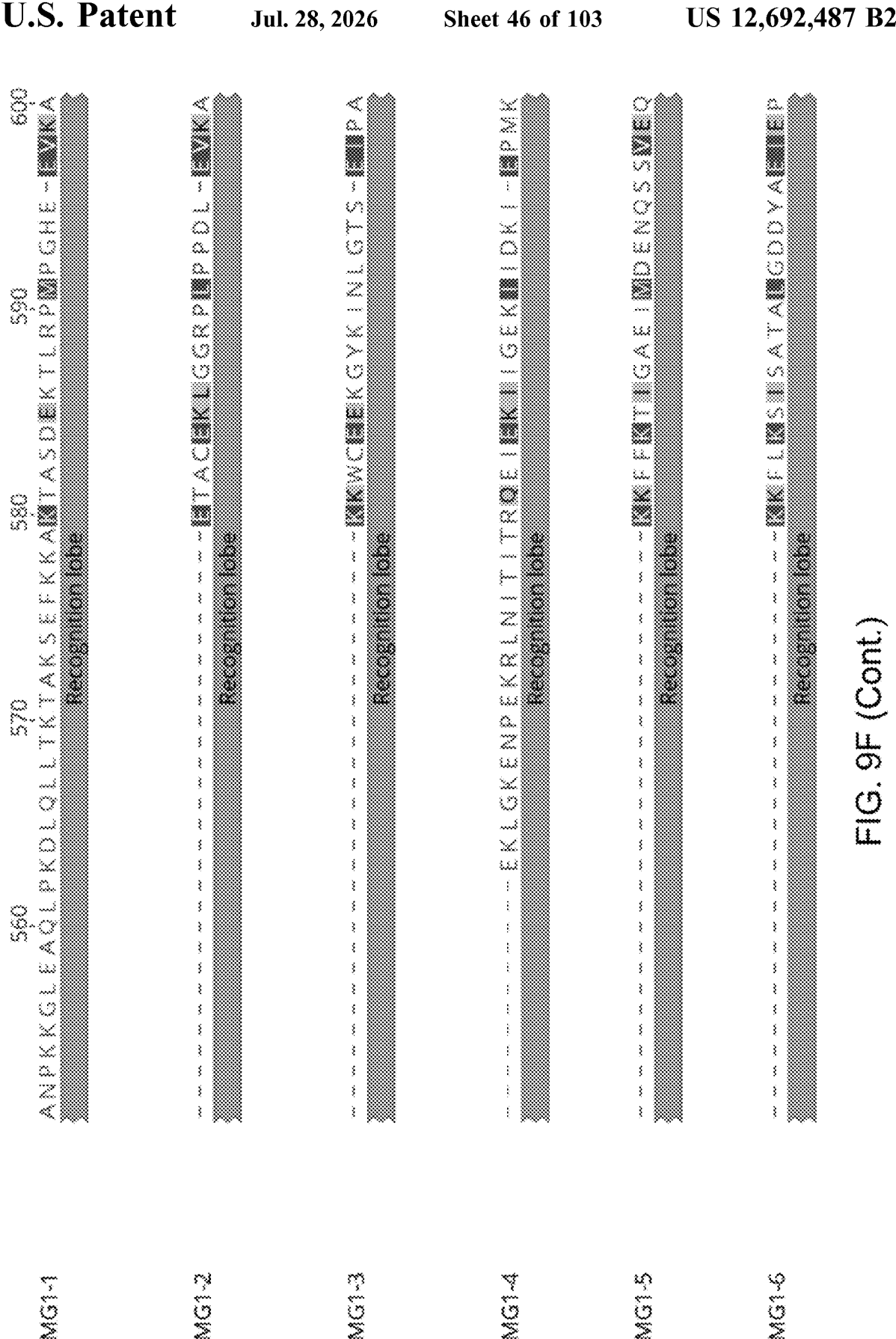
Figure 9G:
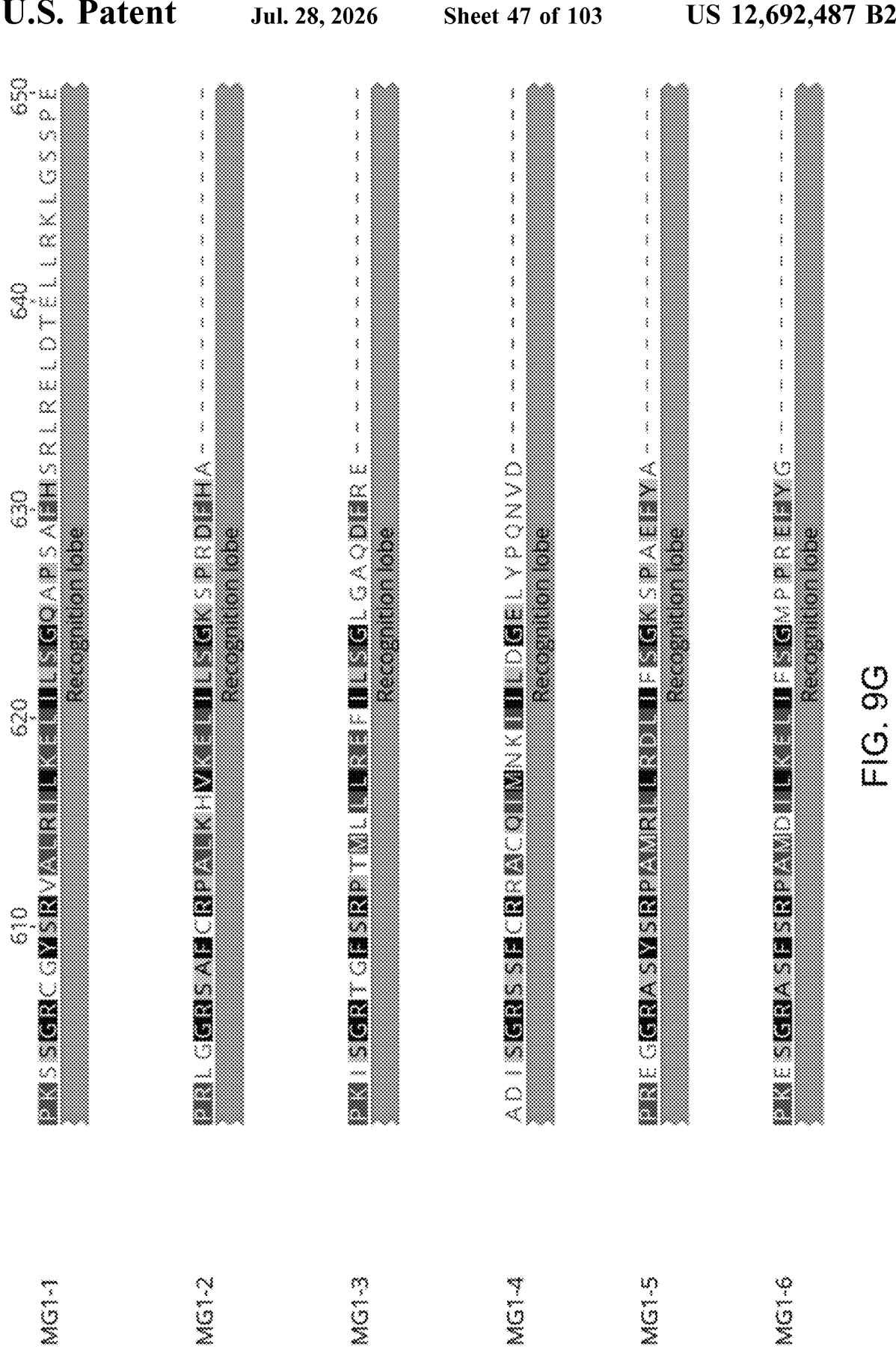
Figure 9G:
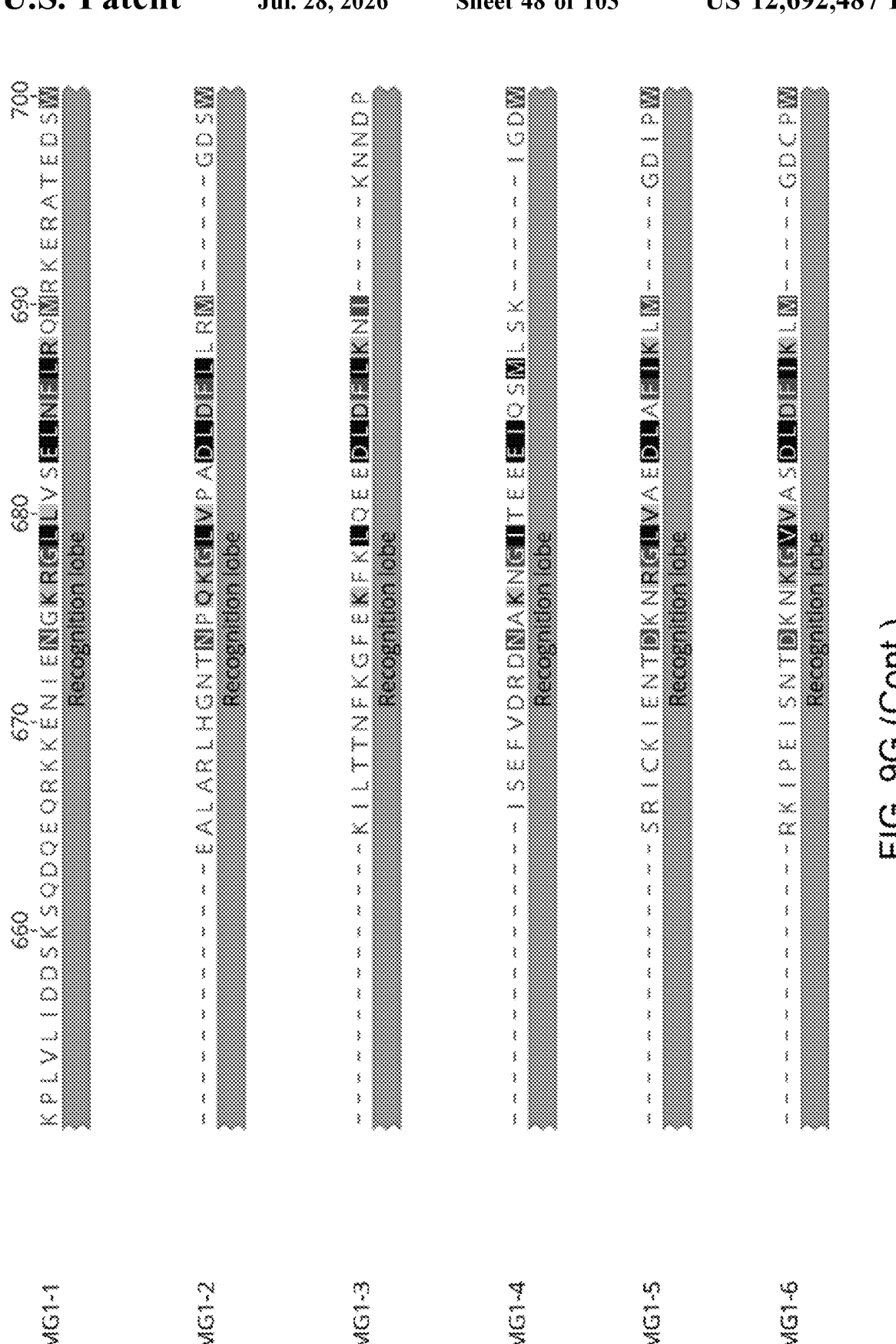
Figure 9I:
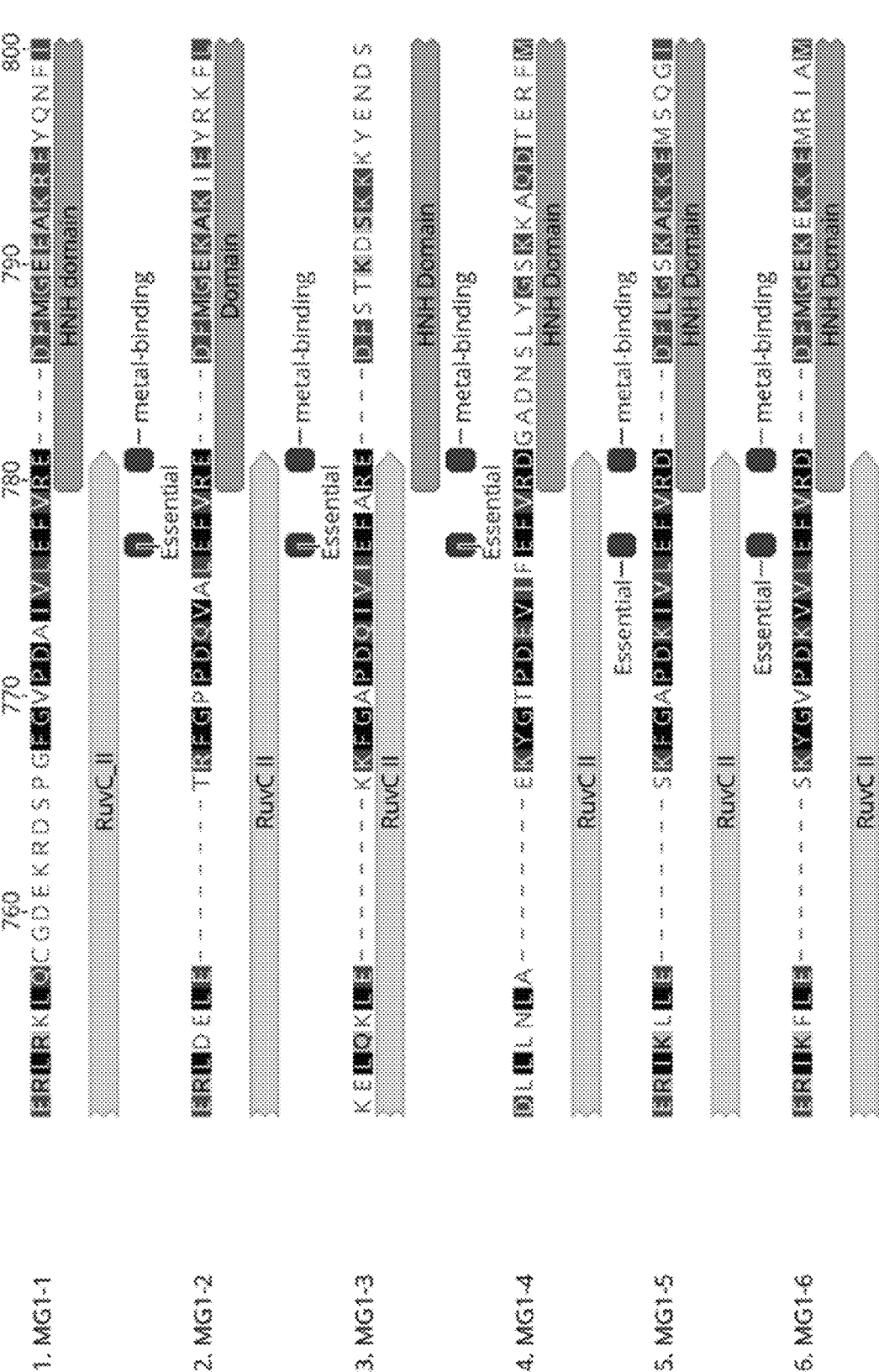
Figure 9I:
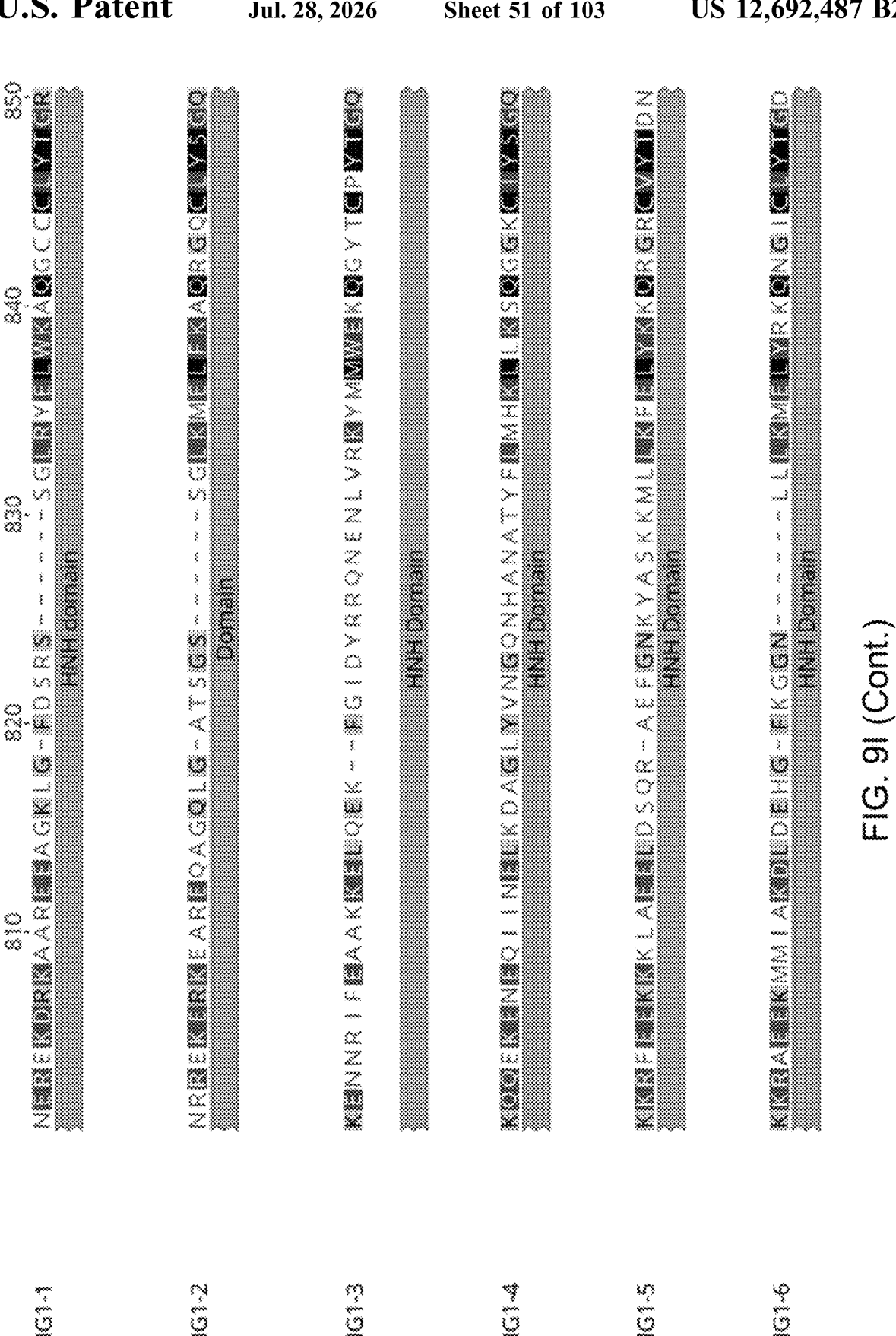
Figure 9J:
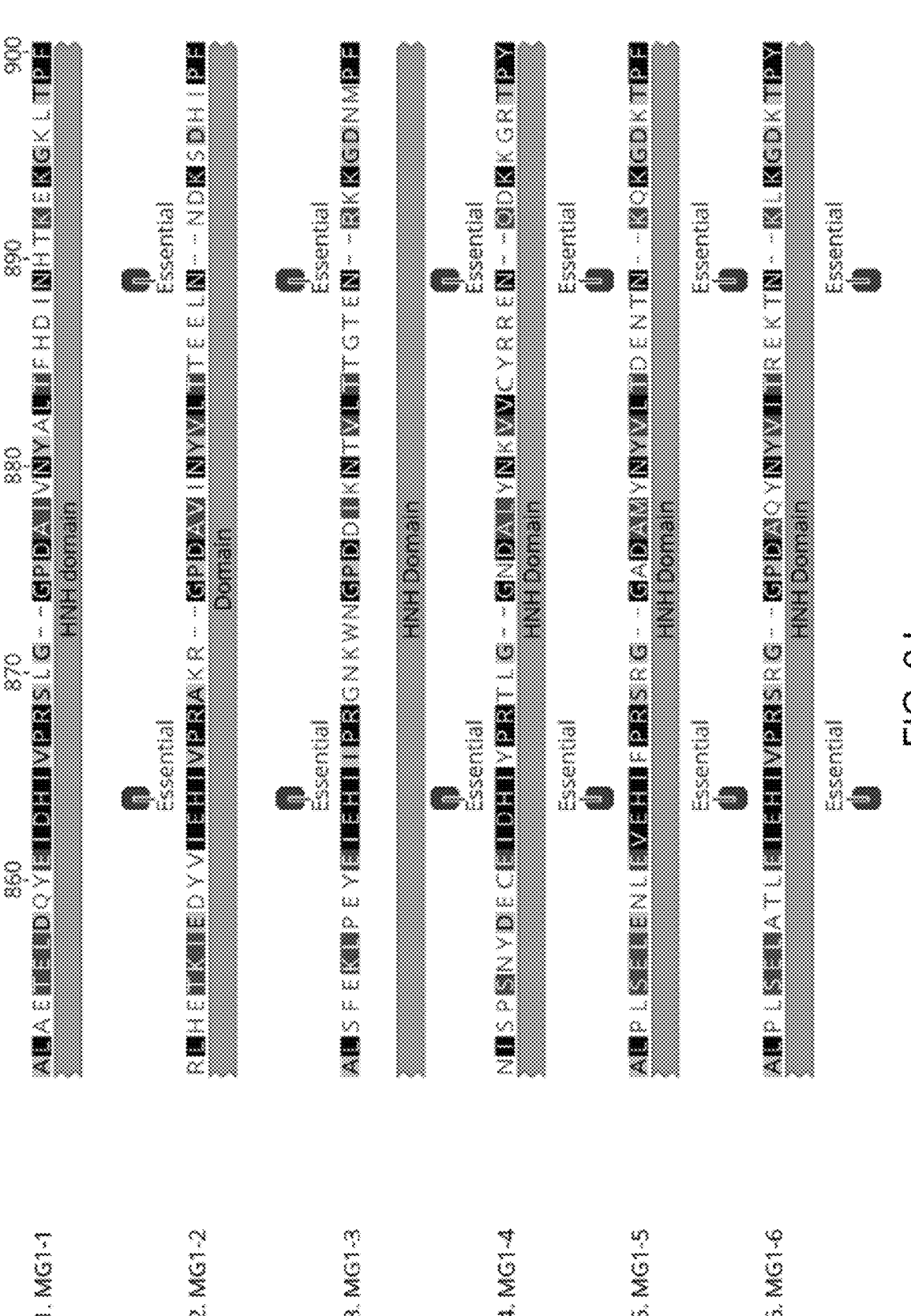
Figure 9K:
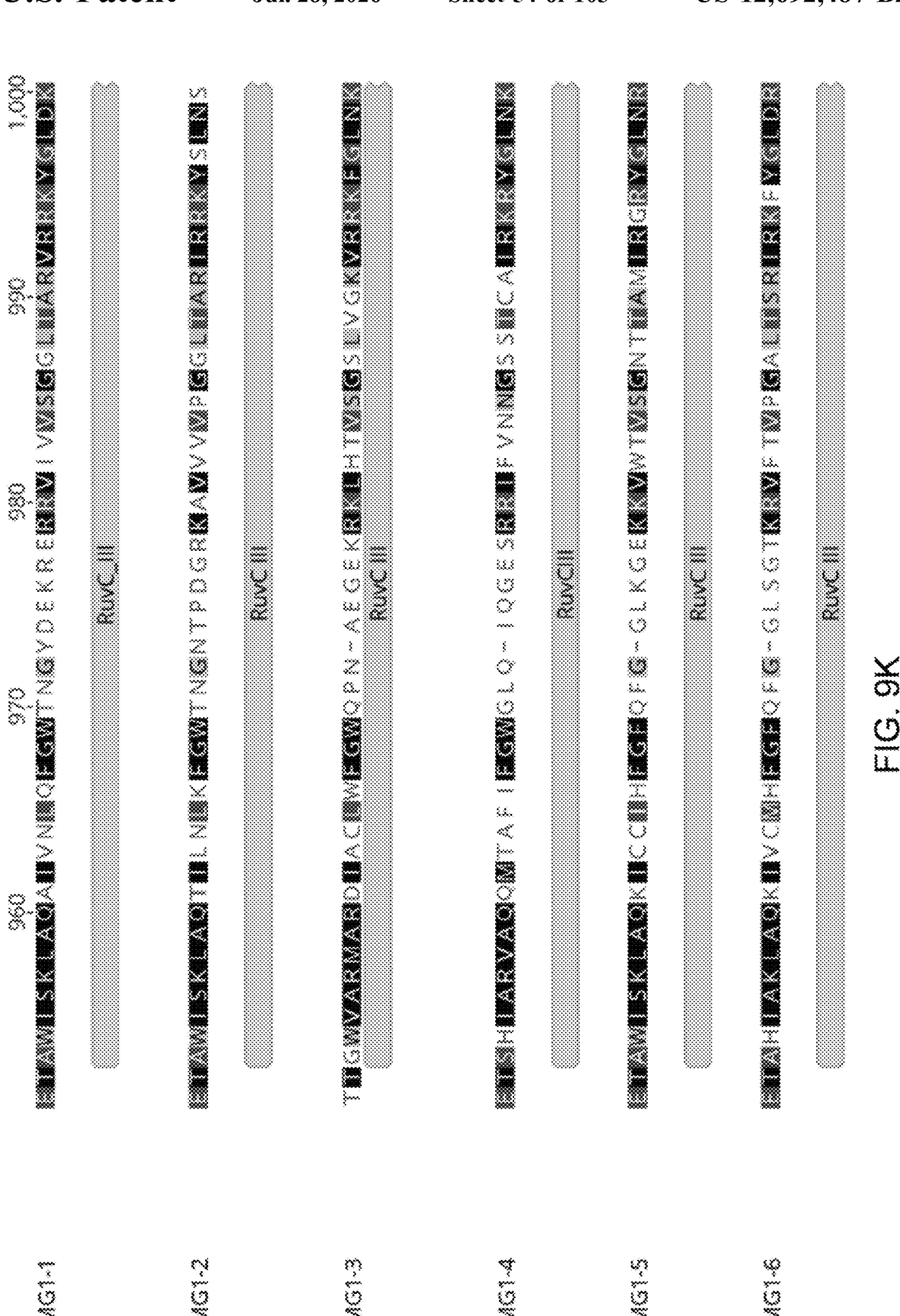
Figure 9K:
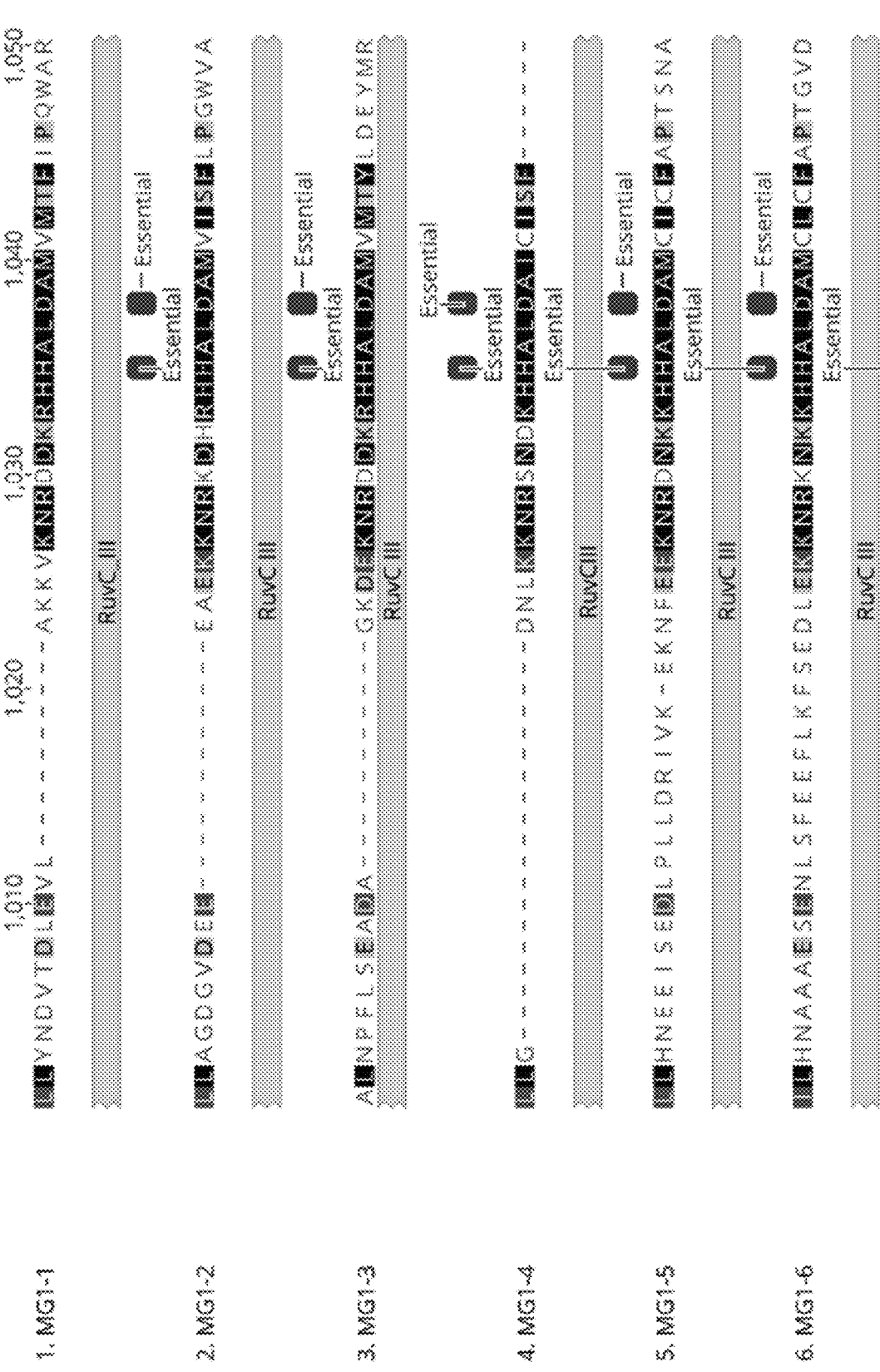
Figure 9M:
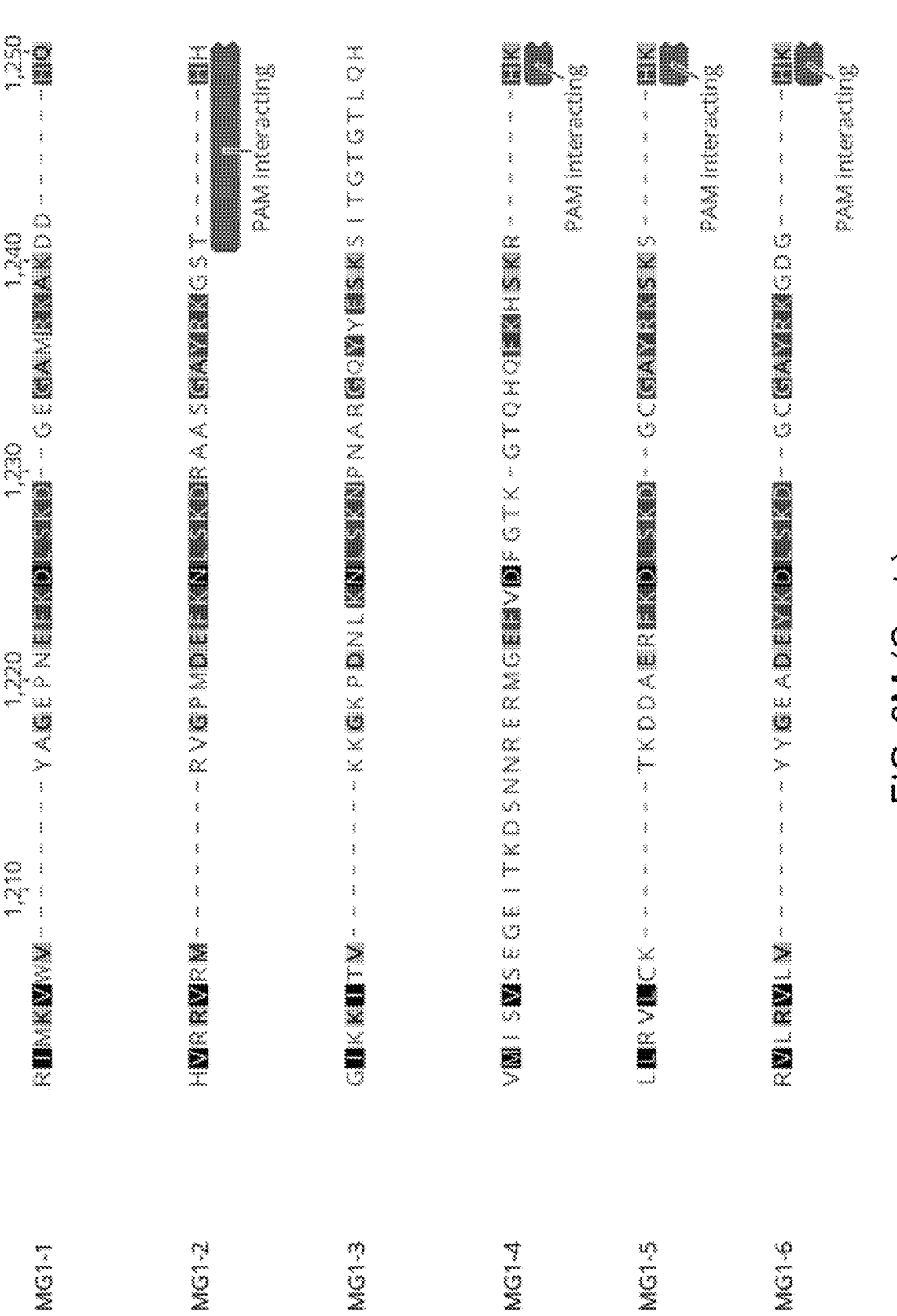
Figure 90:
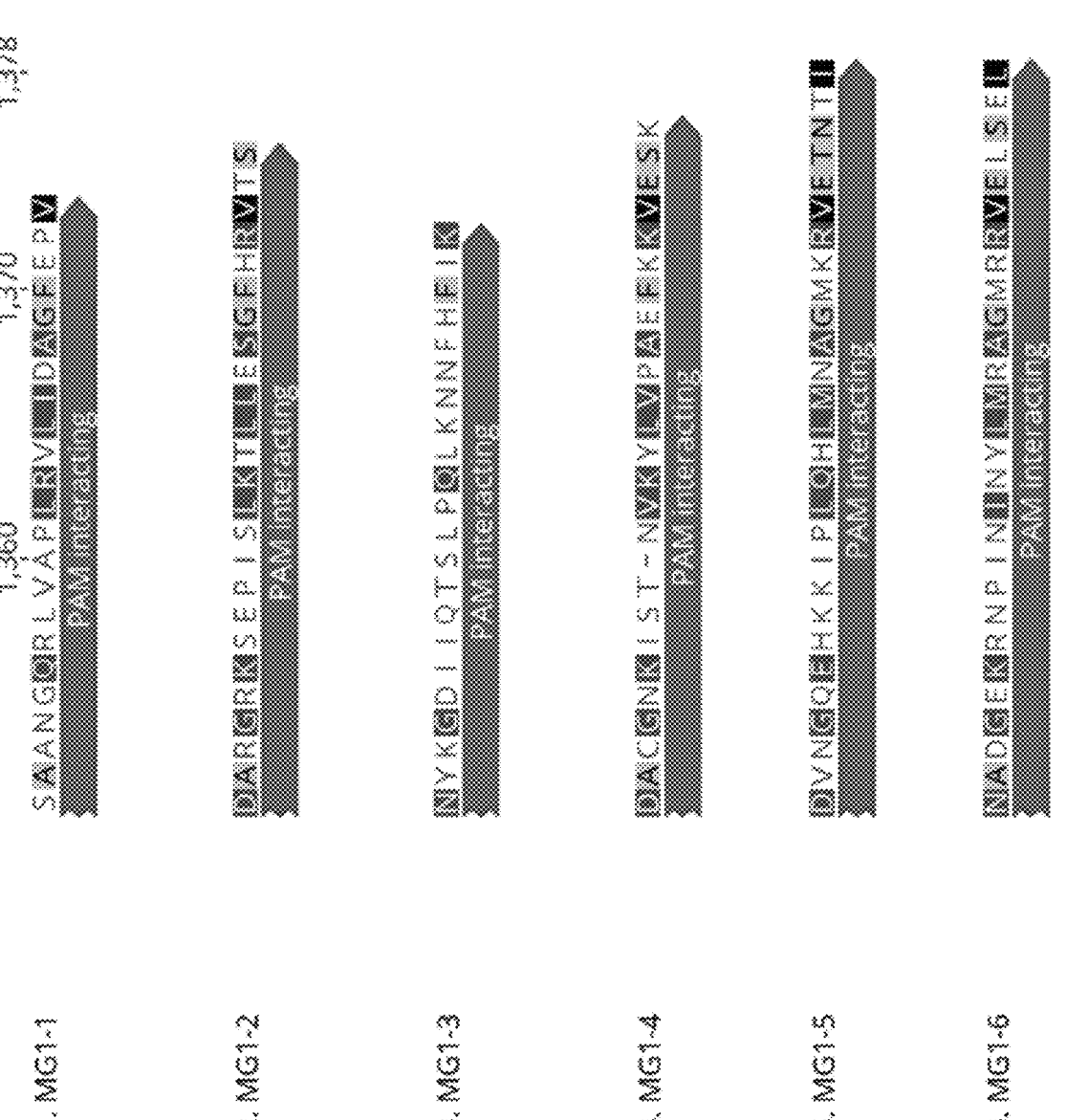

The Sequence Listing filed herewith provides exemplary polynucleotide and polypeptide sequences for use in methods, compositions and systems according to the disclosure. Below are exemplary descriptions of sequences therein.

MG1

SEQ ID NOs: 1-319 show the full-length peptide sequences of MG1 nucleases.

SEQ ID NOs: 1827-2140 show the peptide sequences of RuvC_III domains of MG1 nucleases above.

SEQ ID NOs: 3638-3955 show the peptide of HNH domains of MG1 nucleases above.

SEQ ID NOs: 5476-5479 show the nucleotide sequences of MG1 tracrRNAs derived from the same loci as MG1 nucleases above (e.g., same loci as SEQ ID NO:1-4, respectively).

SEQ ID NOs: 5461-5464 show the nucleotide sequences of sgRNAs engineered to function with an MG1 nuclease (e.g., SEQ ID NO:1-4, respectively), where Ns denote nucleotides of a targeting sequence.

SEQ ID NOs: 5572-5575 show nucleotide sequences for *E. coli* codon-optimized coding sequences for MG1 family enzymes (SEQ ID NOs: 1-4).

SEQ ID NOs: 5588-5589 show nucleotide sequences for human codon-optimized coding sequences for MG1 family enzymes (SEQ ID NOs: 1 and 3).

SEQ ID NOs: 5616-5632 show peptide motifs characteristic of MG1 family enzymes.

MG2

SEQ ID NOs: 320-420 show the full-length peptide sequences of MG2 nucleases.

SEQ ID NOs: 2141-2241 show the peptide sequences of RuvC_III domains of MG2 nucleases above.

SEQ ID NOs: 3955-4055 show the peptide of HNH domains of MG2 nucleases above.

SEQ ID NOs: 5490-5494 show the nucleotide sequences of MG2 tracrRNAs derived from the same loci as MG2 nucleases above (e.g., same loci as SEQ ID NOs: 320, 321, 323, 325, and 326, respectively).

SEQ ID NO: 5465 shows the nucleotide sequence of an sgRNA engineered to function with an MG2 nuclease (e.g., SEQ ID NO: 321 above).

SEQ ID NOs: 5572-5575 show nucleotide sequences for *E. coli* codon-optimized coding sequences for MG2 family enzymes.

SEQ ID NOs: 5631-5638 show peptide sequences characteristic of MG2 family enzymes.

MG3

SEQ ID NOs: 421-431 show the full-length peptide sequences of MG3 nucleases.

SEQ ID NOs: 2242-2252 show the peptide sequences of RuvC_III domains of MG3 nucleases above.

SEQ ID NOs: 4056-4066 show the peptide of HNH domains of MG3 nucleases above.

SEQ ID NOs: 5495-5502 show the nucleotide sequences of MG3 tracrRNAs derived from the same loci as MG3 nucleases above (e.g., same loci as SEQ ID NOs: 421-428, respectively).

SEQ ID NOs: 5466-5467 show the nucleotide sequence of sgRNAs engineered to function with an MG3 nuclease (e.g., SEQ ID NOs: 421-423).

SEQ ID NOs: 5578-5580 show nucleotide sequences for *E. coli* codon-optimized coding sequences for MG3 family enzymes.

SEQ ID NOs: 5639-5648 show peptide sequences characteristic of MG3 family enzymes.

MG4

SEQ ID NOs: 432-660 show the full-length peptide sequences of MG4 nucleases.

SEQ ID NOs: 2253-2481 show the peptide sequences of RuvC_III domains of MG4 nucleases above.

SEQ ID NOs: 4067-4295 show the peptide of HNH domains of MG4 nucleases above.

SEQ ID NO: 5503 shows the nucleotide sequences of an MG4 tracrRNA derived from the same loci as MG4 nucleases above.

SEQ ID NO: 5468 shows the nucleotide sequence of sgRNAs engineered to function with an MG4 nuclease.

SEQ ID NO: 5649 shows a peptide sequence characteristic of MG4 family enzymes.

MG6

SEQ ID NOs: 661-668 show the full-length peptide sequences of MG6 nucleases.

SEQ ID NOs: 2482-2489 show the peptide sequences of RuvC_III domains of MG6 nucleases above.

SEQ ID NOs: 4296-4303 show the peptide of HNH domains of MG3 nucleases above.

MG7

SEQ ID NOs: 669-677 show the full-length peptide sequences of MG7 nucleases.

SEQ ID NOs: 2490-2498 show the peptide sequences of RuvC_III domains of MG7 nucleases above.

SEQ ID NOs: 4304-4312 show the peptide of HNH domains of MG3 nucleases above.

SEQ ID NO: 5504 shows the nucleotide sequence of an MG7 tracrRNA derived from the same loci as MG7 nucleases above.

MG14

SEQ ID NOs: 678-929 show the full-length peptide sequences of MG14 nucleases.

SEQ ID NOs: 2499-2750 show the peptide sequences of RuvC_III domains of MG14 nucleases above.

SEQ ID NOs: 4313-4564 show the peptide of HNH domains of MG14 nucleases above.

SEQ ID NO: 5505 shows the nucleotide sequences of MG14 tracrRNA derived from the same loci as MG14 nucleases above.

SEQ ID NO: 5581 shows a nucleotide sequence for an *E. coli* codon-optimized coding sequences for an MG14 family enzyme.

SEQ ID NOs: 5650-5667 show peptide sequences characteristic of MG14 family enzymes.

MG15

SEQ ID NOs: 930-1092 show the full-length peptide sequences of MG15 nucleases.

SEQ ID NOs: 2751-2913 show the peptide sequences of RuvC_III domains of MG15 nucleases above.

SEQ ID NOs: 4565-4727 show the peptide of HNH domains of MG15 nucleases above.

SEQ ID NO: 5506 shows the nucleotide sequences of MG15 tracrRNA derived from the same loci as MG15 nucleases above.

SEQ ID NOs: 5470 shows the nucleotide sequence of an sgRNA engineered to function with an MG15 nuclease.

SEQ ID NO: 5582 shows a nucleotide sequence for an *E. coli* codon-optimized coding sequences for an MG15 family enzyme.

SEQ ID NOs: 5668-5675 show peptide sequences characteristic of MG15 family enzymes.

MG16

SEQ ID NOs: 1093-1353 show the full-length peptide sequences of MG16 nucleases.

SEQ ID NOs: 2914-3174 show the peptide sequences of RuvC_III domains of MG16 nucleases above.

SEQ ID NOs: 4728-4988 show the peptide of HNH domains of MG16 nucleases above.

SEQ ID NOs: 5507 show the nucleotide sequences of an MG16 tracrRNA derived from the same loci as MG3 nucleases above.

SEQ ID NOs: 5471 shows the nucleotide sequence of sgRNAs engineered to function with an MG16 nuclease.

SEQ ID NO: 5583 shows a nucleotide sequence for an *E. coli* codon-optimized coding sequences for an MG16 family enzyme.

SEQ ID NOs: 5676-5678 show peptide sequences characteristic of MG16 family enzymes.

MG18

SEQ ID NOs: 1354-1511 show the full-length peptide sequences of MG18 nucleases.

SEQ ID NOs: 3175-3330 show the peptide sequences of RuvC_III domains of MG18 nucleases above.

SEQ ID NOs: 4989-5146 show the peptide of HNH domains of MG18 nucleases above.

SEQ ID NO: 5508 shows the nucleotide sequences of MG18 tracrRNA derived from the same loci as MG18 nucleases above.

SEQ ID NOs: 5472 shows the nucleotide sequence of an sgRNA engineered to function with an MG18 nuclease.

SEQ ID NO: 5584 shows a nucleotide sequence for an *E. coli* codon-optimized coding sequences for an MG18 family enzyme.

SEQ ID NOs: 5679-5686 show peptide sequences characteristic of MG18 family enzymes.

MG21

SEQ ID NOs: 1512-1655 show the full-length peptide sequences of MG21 nucleases.

SEQ ID NOs: 3331-3474 show the peptide sequences of RuvC_III domains of MG21 nucleases above.

SEQ ID NOs: 5147-5290 show the peptide of HNH domains of MG21 nucleases above.

SEQ ID NOs: 5509 show the nucleotide sequence of an MG21 tracrRNA derived from the same loci as MG21 nucleases above.

SEQ ID NOs: 5473 shows the nucleotide sequence of an sgRNA engineered to function with an MG21 nuclease.

SEQ ID NO: 5585 shows a nucleotide sequence for an *E. coli* codon-optimized coding sequences for an MG21 family enzyme.

SEQ ID NOs: 5687-5692 and 5674-5675 show peptide sequences characteristic of MG21 family enzymes.

MG22

SEQ ID NOs: 1656-1755 show the full-length peptide sequences of MG22 nucleases.

SEQ ID NOs: 3475-3568 show the peptide sequences of RuvC_III domains of MG22 nucleases above.

SEQ ID NOs: 5291-5389 show the peptide of HNH domains of MG22 nucleases above.

SEQ ID NO: 5510 show the nucleotide sequence of an MG22 tracrRNA derived from the same loci as MG22 nucleases above.

SEQ ID NOs: 5474 shows the nucleotide sequence of an sgRNAs engineered to function with an MG22 nuclease.

SEQ ID NO: 5586 shows a nucleotide sequence for an *E. coli* codon-optimized coding sequences for an MG22 family enzyme.

SEQ ID NOs: 5694-5699 show peptide sequences characteristic of MG22 family enzymes.

MG23

SEQ ID NOs: 1756-1826 show the full-length peptide sequences of MG23 nucleases.

SEQ ID NOs: 3569-3637 show the peptide sequences of RuvC_III domains of MG23 nucleases above.

SEQ ID NOs: 5390-5460 show the peptide of HNH domains of MG23 nucleases above.

SEQ ID NO: 5511 shows the nucleotide sequences of an MG23 tracrRNA derived from the same loci as MG23 nucleases above.

SEQ ID NOs: 5475 shows the nucleotide sequence of an sgRNA engineered to function with an MG23 nuclease.

SEQ ID NO: 5587 shows a nucleotide sequence for an *E. coli* codon-optimized coding sequences for an MG23 family enzyme.

SEQ ID NOs: 5700-5717 show peptide sequences characteristic of MG23 family enzymes.

DETAILED DESCRIPTION

While various embodiments of the invention have been shown and described herein, it will be obvious to those skilled in the art that such embodiments are provided by way of example only. Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional and/or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, ferns, clubmosses, homworts, liverworts, mosses), an algal cell, (e.g., *Botryococcus braunii, Chlamydomonas reinhardtii, Nannochloropsis gaditana, Chlorella pyrenoidosa, Sargassum patens* C. Agardh, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [uS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethyl-aminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G] ddATP, [dR110]ddCTP, [dTAMRA]ddGTP, and [dROX] ddTTP available from Perkin Elmer, Foster City, Calif;

FluoroLink DeoxyNucleotides, FluoroLink Cy3-dCTP, FluoroLink Cy5-dCTP, FluoroLink Fluor X-dCTP, Fluoro-Link Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxy-ribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudourdine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88.

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary and/or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions and/or deletions. A non-native sequence may exhibit and/or encode for an activity (e.g., enzymatic activity, methyltransferase activity, acetyltransferase activity, kinase activity, ubiquitinating activity, etc.) that may also be exhibited by the nucleic acid and/or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid and/or polypeptide sequence encoding a chimeric nucleic acid and/or polypeptide.

The term "promoter", as used herein, generally refers to the regulatory DNA region which controls transcription or expression of a gene and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic necessary elements to promote transcriptional expression of an operably linked polynucleotide. Eukaryotic basal promoters typically, though not necessarily, contain a TATA-box and/or a CAAT box.

The term "expression", as used herein, generally refers to the process by which a nucleic acid sequence or a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter and/or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner known to be attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" are used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

The term "tracrRNA" or "tracr sequence", as used herein, can generally refer to a nucleic acid with at least about 5%, 10%, 20%, 30%, 40%, 50%, 60%, 70%, 80%, 90%, 95%, or 100% sequence identity and/or sequence similarity to a wild type exemplary tracrRNA sequence (e.g., a tracrRNA from *S. pyogenes S. aureus*, etc or SEQ ID NOs: 5476-5511). tracrRNA can refer to a nucleic acid with at most about 5%, 10%, 20%, 30%, 40%, 50%, 60%, 70%, 80%, 90%, or 100% sequence identity and/or sequence similarity to a wild type exemplary tracrRNA sequence (e.g., a tracrRNA from *S.*

*pyogenes S. aureus*, etc). tracrRNA may refer to a modified form of a tracrRNA that can comprise a nucleotide change such as a deletion, insertion, or substitution, variant, mutation, or chimera. A tracrRNA may refer to a nucleic acid that can be at least about 60% identical to a wild type exemplary tracrRNA (e.g., a tracrRNA from *S. pyogenes S. aureus*, etc) sequence over a stretch of at least 6 contiguous nucleotides. For example, a tracrRNA sequence can be at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical to a wild type exemplary tracrRNA (e.g., a tracrRNA from *S. pyogenes S. aureus*, etc) sequence over a stretch of at least 6 contiguous nucleotides. Type II tracrRNA sequences can be predicted on a genome sequence by identifying regions with complementarity to part of the repeat sequence in an adjacent CRISPR array.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation (E) of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at www.blast.ncbi.nlm.nih.gov); CLUSTALW with parameters of; the Smith-Waterman homology search algorithm with parameters of a match of 2, a mismatch of −1, and a gap of −1; MUSCLE with default parameters; MAFFT with parameters retree of 2 and maxiterations of 1000; Novafold with default parameters; HMMER hmmalign with default parameters.

Included in the current disclosure are variants of any of the enzyme described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally or alternatively, by comparing aligned sequences of homologous proteins from different species, conservative substitutions can be identified by locating amino acid residues that have been mutated between species (e.g. non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein (e.g. MG1, MG2, MG3, MG4, MG6, MG7, MG14, MG15, MG16, MG18, MG21, MG22, or MG23 family endonucleases described herein). In some embodiments, such conservatively substituted variants are functional variants. Such functional variants can encompass sequences with substitutions such that the activity of critical active site residues of the endonuclease are not disrupted.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M).

As used herein, the term "RuvC_III domain" generally refers to a third discontinuous segment of a RuvC endonuclease domain (the RuvC nuclease domain being comprised of three discontiguous segments, RuvC_I, RuvC_II, and RuvC_III). A RuvC domain or segments thereof can generally be identified by alignment to known domain sequences, structural alignment to proteins with annotated domains, or by comparison to Hidden Markov Models (HMMs) built based on known domain sequences (e.g., Pfam HMM PF18541 for RuvC_III).

As used herein, the term "HNH domain" generally refers to an endonuclease domain having characteristic histidine and asparagine residues. An HNH domain can generally be identified by alignment to known domain sequences, structural alignment to proteins with annotated domains, or by comparison to Hidden Markov Models (HMMs) built based on known domain sequences (e.g., Pfam HMM PF01844 for domain HNH).

Overview

The discovery of new Cas enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, relatively few functionally characterized CRISPR/Cas enzymes exist in the literature. This is partly because a huge number of microbial species may not be readily cultivated in laboratory conditions. Metagenomic sequencing from natural environmental niches that represent large numbers of microbial species may offer the potential to drastically increase the number of new CRISPR/Cas systems known and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR/Cas systems are RNA-directed nuclease complexes that have been described to function as an adaptive immune system in microbes. In their natural context, CRISPR/Cas systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the Cas encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR-Cas systems are commonly organized into 2 classes, 5 types and 16 subtypes based on shared functional characteristics and evolutionary similarity.

Class I CRISPR-Cas systems have large, multisubunit effector complexes, and comprise Types I, III, and IV.

Type I CRISPR-Cas systems are considered of moderate complexity in terms of components. In Type I CRISPR-Cas systems, the array of RNA-targeting elements is transcribed as a long precursor crRNA (pre-crRNA) that is processed at repeat elements to liberate short, mature crRNAs that direct the nuclease complex to nucleic acid targets when they are followed by a suitable short consensus sequence called a protospacer-adjacent motif (PAM). This processing occurs via an endoribonuclease subunit (Cas6) of a large endonuclease complex called Cascade, which also comprises a nuclease (Cas3) protein component of the crRNA-directed nuclease complex. Cas I nucleases function primarily as DNA nucleases.

Type III CRISPR systems may be characterized by the presence of a central nuclease, known as Cas10, alongside a repeat-associated mysterious protein (RAMP) that comprises Csm or Cmr protein subunits. Like in Type I systems, the mature crRNA is processed from a pre-crRNA using a Cas6-like enzyme. Unlike type I and II systems, type III systems appear to target and cleave DNA-RNA duplexes (such as DNA strands being used as templates for an RNA polymerase).

Type IV CRISPR-Cas systems possess an effector complex that consists of a highly reduced large subunit nuclease (csf1), two genes for RAMP proteins of the Cas5 (csf3) and Cas7 (csf2) groups, and, in some cases, a gene for a predicted small subunit; such systems are commonly found on endogenous plasmids.

Class II CRISPR-Cas systems generally have single-polypeptide multidomain nuclease effectors, and comprise Types II, V and VI.

Type II CRISPR-Cas systems are considered the simplest in terms of components. In Type II CRISPR-Cas systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Cas II nucleases are known as DNA nucleases. Type 2 effectors generally exhibit a structure consisting of a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR-Cas systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR-Cas systems, Type V CRISPR-Cas systems are again known as DNA nucleases. Unlike Type II CRISPR-Cas systems, some Type V enzymes (e.g., Cas12a) appear to have a robust single-stranded nonspecific deoxyribonuclease activity that is activated by the first crRNA directed cleavage of a double-stranded target sequence.

Type VI CRISPR-Cas systems have RNA-guided RNA endonucleases. Instead of RuvC-like domains, the single polypeptide effector of Type VI systems (e.g. Cas13) comprises two HEPN ribonuclease domains. Differing from both Type II and V systems, Type VI systems also appear to not need a tracrRNA for processing of pre-crRNA into crRNA. Similar to type V systems, however, some Type VI systems (e.g., C2C2) appear to possess robust single-stranded nonspecific nuclease (ribonuclease) activity activated by the first crRNA directed cleavage of a target RNA.

Because of their simpler architecture, Class II CRISPR-Cas have been most widely adopted for engineering and development as designer nuclease/genome editing applications.

One of the early adaptations of such a system for in vitro use can be found in Jinek et al. (Science. 2012 Aug. 17; 337(6096):816-21, which is entirely incorporated herein by reference). The Jinek study first described a system that involved (i) recombinantly-expressed, purified full-length Cas9 (e.g., a Class II, Type II Cas enzyme) isolated from *S.*

*pyogenes* SF370, (ii) purified mature ~42 nt crRNA bearing a ~20 nt 5' sequence complementary to the target DNA sequence desired to be cleaved followed by a 3' tracr-binding sequence (the whole crRNA being in vitro transcribed from a synthetic DNA template carrying a T7 promoter sequence); (iii) purified tracrRNA in vitro transcribed from a synthetic DNA template carrying a T7 promoter sequence, and (iv) Mg²⁺. Jinek later described an improved, engineered system wherein the crRNA of (ii) is joined to the 5' end of (iii) by a linker (e.g., GAAA) to form a single fused synthetic guide RNA (sgRNA) capable of directing Cas9 to a target by itself (compare top and bottom panel of FIG. 2).

Mali et al. (Science. 2013 Feb. 15; 339(6121): 823-826.), which is entirely incorporated herein by reference, later adapted this system for use in mammalian cells by providing DNA vectors encoding (i) an ORF encoding codon-optimized Cas9 (e.g., a Class II, Type II Cas enzyme) under a suitable mammalian promoter with a C-terminal nuclear localization sequence (e.g., SV40 NLS) and a suitable polyadenylation signal (e.g., TK pA signal); and (ii) an ORF encoding an sgRNA (having a 5' sequence beginning with G followed by 20 nt of a complementary targeting nucleic acid sequence joined to a 3' tracr-binding sequence, a linker, and the tracrRNA sequence) under a suitable Polymerase III promoter (e.g., the U6 promoter).

MG1 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 1827-2140. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 1827-2140. In some cases, the endonuclease may comprise a RuvC_III domain, wherein the substantially identical to any one of SEQ ID NOs: 1827-2140. The endonuclease may comprise a RuvC_III domain having at least about 70% sequence identity to any one of SEQ ID NOs: 1827-1831. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 1827-1831. In some cases, the endonuclease may comprise a RuvC_III domain substantially identical to any one of SEQ ID NOs: 1827-1831. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1827. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1828. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1829. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1830. In some cases, the endonuclease may comprise a RuvC_III domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to SEQ ID NO: 1831.

The endonuclease may comprise an HNH domain having at least about 70% identity to any one of SEQ ID NOs: 3638-3955. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3955. The endonuclease may comprise an HNH domain substantially identical to any one of SEQ ID NOs: 3638-3955. The endonuclease may comprise an HNH domain having at least about 70% identity to any one of SEQ ID NOs: 3638-3955. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3955. The endonuclease may comprise an HNH domain substantially identical to any one of SEQ ID NOs: 3638-3955. The endonuclease may comprise an HNH domain having at least about 70% identity to any one of SEQ ID NOs: 3638-3641. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638-3641. The endonuclease may comprise an HNH domain substantially identical to any one of SEQ ID NOs: 3638-3641. The endonuclease may comprise an HNH domain having at least about 70% identity to any one of SEQ ID NOs: 3638. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3638. The endonuclease may comprise an HNH domain substantially identical to any one of SEQ ID NOs: 3638. The endonuclease may comprise an HNH domain having at least about 70% identity to any one of SEQ ID NOs: 3639. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3639. The endonuclease may comprise an HNH domain substantially identical to any one of SEQ ID NOs: 3639. The endonuclease may comprise an HNH domain having at least about 70% identity to any one of SEQ ID NOs: 3640. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3640. The endonuclease may comprise an HNH domain substantially identical to any one of SEQ ID NOs: 3640. The endonuclease may comprise an HNH domain having at least about 70% identity to any one of SEQ ID NOs: 3641. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3641. The endonuclease may comprise an HNH domain substantially identical to any one of SEQ ID NOs: 3641.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1-6 or 9-319. In some cases, the endonuclease may be substantially identical to any one of SEQ ID NOs: 1-6 or 9-319. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:1-4. In some cases, the endonuclease may be substantially identical to any one of SEQ ID NOs: 1-4. In some cases, the endonuclease may comprise a peptide motif substantially identical to any one of SEQ ID NOs: 5615, 5616, or 5617.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1-6 or 9-319, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1-319. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 below, or a combination thereof:

TABLE 1

Example NLS Sequences that can be used with Cas Effectors According to the Disclosure

| Source | NLS amino acid sequence | SEQ ID NO: |
|---|---|---|
| SV40 | PKKKRKV | 5597 |
| nucleoplasmin bipartite NLS | KRPAATKKAGQAKKKK | 5598 |
| c-myc NLS | PAAKRVKLD | 5599 |
| c-myc NLS | RQRRNELKRSP | 5600 |
| hRNPA1 M9NLS | NQSSNFGPMKGGNFGGRSSGPYGGGGQYFA KPRNQGGY | 5601 |
| Importin-alpha IBB domain | RMRIZFKNKGKDTAELRRRRVEVSVELRKAK KDEQILKRRNV | 5602 |
| Myoma T protein | VSRKRPRP | 5603 |
| Myoma T protein | PPKKARED | 5604 |
| p53 | PQPKKKPL | 5605 |
| mouse c-abl IV | SALIKKKKKMAP | 5606 |
| influenza virus NS1 | DRLRR | 5607 |
| influenza virus NS1 | PKQKKRK | 5608 |

TABLE 1-continued

Example NLS Sequences that can be used with Cas Effectors According to the Disclosure

| Source | NLS amino acid sequence | SEQ ID NO: |
|---|---|---|
| Hepatitis virus delta antigen | RKLKKKIKKL | 5609 |
| mouse Mx1 protein | REKKKFLKRR | 5610 |
| human poly(ADP-ribose) polymerase | KRKGDEVDGVDEVAKKKSKK | 5611 |
| steroid hormone receptor (human) glucocorticoid | RKCLQAGMNLEARKTKK | 5612 |

In some cases, the endonuclease may be recombinant (e.g., cloned, expressed, and purified by a suitable method such as expression in *E. coli* followed by epitope-tag purification). In some cases, the endonuclease may be derived from a bacterium with a 16S rRNA gene having at least about 90% identity to any one of SEQ ID NOs: 5592-5595. The endonuclease may be derived from a species having a 16S rRNA gene at least about 80%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5592-5595. The endonuclease may be derived from a species having a 16S rRNA gene substantially identical to any one of SEQ ID NOs: 5592-5595. The endonuclease may be derived from a bacterium belonging to the Phylum Verrucomicrobia or the Phylum Candidatus Peregrinibacteria.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5476-5489. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5476-5489. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5476-5489. The tracrRNA may comprise any of SEQ ID NOs: 5476-5489.

In some cases, the at least one engineered synthetic guide ribonucleic acid (sgRNA) capable of forming a complex with the endonuclease may comprise a sequence having at least about 80% identity to any one of SEQ ID NOs: 5461-5464. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5461-5464. The sgRNA may comprise a sequence substantially identical to any one of SEQ ID NOs: 5461-5464.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus, may modify the target nucleic acid locus. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 1827-2140. The deoxyribonucleic acid (DNA) containing an open reading frame encoding said endonuclease may comprise a sequence substantially identical to any of SEQ ID NOs: 5572-5575 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5572-5575. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

In some cases, the present disclosure may provide for an expression cassette comprising the system disclosed herein, or the nucleic acid described herein. In some cases, the expression cassette or nucleic acid may be supplied as a vector. In some cases, the expression cassette, nucleic acid, or vector may be supplied in a cell. In some cases, the cell is a cell of a bacterium with a 16S rRNA gene having at least about 90% (e.g., at least about 99%) identity to any one of SEQ ID NOs: 5592-5595.

MG2 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2141-2241. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2141-2241. In some cases, the endonuclease may comprise a RuvC_III domain, wherein the substantially identical to any one of SEQ ID NOs: 2141-2142. The endonuclease may comprise a RuvC_III domain having at least about 70% sequence identity to any one of SEQ ID NOs: 2141-2142. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2141-2142. In some cases, the endonuclease may comprise a RuvC_III domain substantially identical to any one of SEQ ID NOs: 2141-2142.

The endonuclease may comprise an HNH domain having at least about 70% identity to any one of SEQ ID NOs: 3955-4055. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3955-4055. The endonuclease may comprise an HNH domain substantially identical to any one of SEQ ID NOs: 3955-4055. The endonuclease may comprise an HNH domain having at least about 70% identity to any one of SEQ ID NOs: 3955-3956. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 3955-3956. The endonuclease may comprise an HNH domain substantially identical to any one of SEQ ID NOs: 3955-3956.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 320-420. In some cases, the endonuclease may be substantially identical to any one of SEQ ID NOs: 320-420. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:320-321. In some cases, the endonuclease may be substantially identical to any one of SEQ ID NOs: 320-321.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 320-420, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 320-420. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5490-5494. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5490-5494. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5490-5494. The tracrRNA may comprise any of SEQ ID NOs: 5490-5494.

In some cases, the at least one engineered synthetic guide ribonucleic acid (sgRNA) capable of forming a complex with the endonuclease may comprise a sequence having at least about 80% identity to SEQ ID NO: 5465. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5465. The sgRNA may comprise a sequence substantially identical to SEQ ID NO: 5465.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2141-2241. The deoxyribonucleic acid (DNA) containing an open reading frame encoding said endonuclease may comprise a sequence substantially identical to any of SEQ ID NOs: 5576-5577 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5576-5577. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG3 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2242-2251. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2251. In some cases, the endonuclease may comprise a RuvC_III domain, wherein the substantially identical to any one of SEQ ID NOs: 2242-2251. The endonuclease may comprise a RuvC_III domain having at least about 70% sequence identity to any one of SEQ ID NOs: 2242-2244. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2242-2244. In some cases, the endonuclease may comprise a RuvC_III domain substantially identical to any one of SEQ ID NOs: 2242-2244.

The endonuclease may comprise an HNH domain having at least about 70% identity to any one of SEQ ID NOs: 4056-4066. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4066. The endonuclease may comprise an HNH domain substantially identical to any one of SEQ ID NOs: 4056-4066. The endonuclease may comprise an HNH domain having at least about 70% identity to any one of SEQ ID NOs: 4056-4058. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4056-4058. The endonuclease may comprise an HNH domain substantially identical to any one of SEQ ID NOs: 4056-4058.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. In some cases, the endonuclease may be substantially identical to any one of SEQ ID NOs: 421-431. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs:421-423. In some cases, the endonuclease may be substantially identical to any one of SEQ ID NOs: 421-423.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 421-431, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 421-431. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of any one of SEQ ID NOs: 5495-5502. In some cases, the tracrRNA may be substantially identical to at least about 60-100 (e.g., at least about 60, at least about 65, at least about 70, at least about 75, at least about 80, at least about 85, or at least about 90) consecutive nucleotides of any one of SEQ ID NOs: 5495-5502. The tracrRNA may comprise any of SEQ ID NOs: 5495-5502.

In some cases, the at least one engineered synthetic guide ribonucleic acid (sgRNA) capable of forming a complex with the endonuclease may comprise a sequence having at least about 80% identity to any one of SEQ ID NOs: 5466-5467. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to any one of SEQ ID NOs: 5466-5467. The sgRNA may comprise a sequence substantially identical to any one of SEQ ID NOs: 5466-5467.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2242-2251. The deoxyribonucleic acid (DNA) containing an open reading frame encoding said endonuclease may comprise a sequence substantially identical to any of SEQ ID NOs: 5578-5580 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 5578-5580. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG4 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2253-2481. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2253-2481. In some cases, the endonuclease may comprise a RuvC_III domain, wherein the substantially identical to any one of SEQ ID NOs: 2253-2481. The endonuclease may comprise a RuvC_III domain having at least about 70% sequence identity to any one of SEQ ID NOs: 2253-2481. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2253-2481. In some cases, the endonuclease may comprise a RuvC_III domain substantially identical to any one of SEQ ID NOs: 2253-2481.

The endonuclease may comprise an HNH domain having at least about 70% identity to any one of SEQ ID NOs: 4067-4295. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4067-4295. The endonuclease may comprise an HNH domain having at least about 70% identity to any one of SEQ ID NOs: 4067-4295. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4067-4295.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. In some cases, the endonuclease may be substantially identical to any one of SEQ ID NOs: 432-660. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. In some cases, the endonuclease may be substantially identical to any one of SEQ ID NOs: 432-660.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 432-660, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 432-660. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprise a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5503. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5503. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5503. The tracrRNA may comprise SEQ ID NO: 5503.

In some cases, the at least one engineered synthetic guide ribonucleic acid (sgRNA) capable of forming a complex with the endonuclease may comprise a sequence having at least about 80% identity to SEQ ID NO: 5468. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5468. The sgRNA may comprise a sequence substantially identical to SEQ ID NO: 5468.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2253-2481. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG6 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2482-2489. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2482-2489. In some cases, the endonuclease may comprise a RuvC_III domain, wherein the substantially identical to any one of SEQ ID NOs: 2482-2489.

The endonuclease may comprise an HNH domain having at least about 70% identity to any one of SEQ ID NOs: 4296-4303. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4296-4303. The endonuclease may comprise an HNH domain substantially identical to any one of SEQ ID NOs: 4056-4066.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 661-668. In some cases, the endonuclease may be substantially identical to any one of SEQ ID NOs: 661-668.

In some cases, the endonuclease may comprise a variant having one or more nuclear localization sequences (NLSs).

The NLS may be proximal to the N- or C-terminus of said endonuclease. The NLS may be appended N-terminal or C-terminal to any one of SEQ ID NOs: 661-668, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 661-668. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence.

In some cases, the system above may comprise two different guide RNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest.

The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2482-2489. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG7 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2490-2498. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2490-2498. In some cases, the endonuclease may comprise a RuvC_III domain, wherein the substantially identical to any one of SEQ ID NOs:

2490-2498. The endonuclease may comprise a RuvC_III domain having at least about 70% sequence identity to any one of SEQ ID NOs: 2490-2498. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2490-2498. In some cases, the endonuclease may comprise a RuvC_III domain substantially identical to any one of SEQ ID NOs: 2490-2498.

The endonuclease may comprise an HNH domain having at least about 70% identity to any one of SEQ ID NOs: 4304-4312. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4304-4312. The endonuclease may comprise an HNH domain substantially identical to any one of SEQ ID NOs: 4304-4312. The endonuclease may comprise an HNH domain having at least about 70% identity to any one of SEQ ID NOs: 4304-4312. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4304-4312. The endonuclease may comprise an HNH domain substantially identical to any one of SEQ ID NOs: 4304-4312.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. In some cases, the endonuclease may be substantially identical to any one of SEQ ID NOs: 669-677. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. In some cases, the endonuclease may be substantially identical to any one of SEQ ID NOs: 669-677.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 669-677, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 669-677. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5504. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5504. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5504. The tracrRNA may comprise SEQ ID NO: 5504.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2490-2498. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG14 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2499-2750. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2499-2750. In some cases, the endonuclease may comprise a RuvC_III domain, wherein the substantially identical to any one of SEQ ID NOs: 2499-2750. The endonuclease may comprise a RuvC_III domain having at least about 70% sequence identity to any one of SEQ ID NOs: 2499-2750. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2499-2750. In some cases, the endonuclease may comprise a RuvC_III domain substantially identical to any one of SEQ ID NOs: 2499-2750.

The endonuclease may comprise an HNH domain having at least about 70% identity to any one of SEQ ID NOs: 4313-4564. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4313-4564. The endonuclease may comprise an HNH domain substantially identical to any one of SEQ ID NOs: 4313-4564. The endonuclease may comprise an HNH domain having at least about 70% identity to any one of SEQ ID NOs: 4313-4564. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4067-4295. The endonuclease may comprise an HNH domain substantially identical to any one of SEQ ID NOs: 4313-4564.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. In some cases, the endonuclease may be substantially identical to any one of SEQ ID NOs: 678-929. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. In some cases, the endonuclease may be substantially identical to any one of SEQ ID NOs: 678-929.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 678-929, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 678-929. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5505. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5505. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5505. The tracrRNA may comprise SEQ ID NO: 5505.

In some cases, the at least one engineered synthetic guide ribonucleic acid (sgRNA) capable of forming a complex with the endonuclease may comprise a sequence having at least about 80% identity to SEQ ID NO: 5469. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5469. The sgRNA may comprise a sequence substantially identical to SEQ ID NO: 5469.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2499-2750. The deoxyribonucleic acid (DNA) containing an open reading frame encoding said endonuclease may comprise a sequence substantially identical to SEQ ID NO: 5581 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5581. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG15 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2751-2913. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2751-2913. In some cases, the endonuclease may comprise a RuvC_III domain, wherein the substantially identical to any one of SEQ ID NOs: 2751-2913. The endonuclease may comprise a RuvC_III domain having at least about 70% sequence identity to any one of SEQ ID NOs: 2751-2913. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2751-2913. In some cases, the endonuclease may comprise a RuvC_III domain substantially identical to any one of SEQ ID NOs: 2751-2913.

The endonuclease may comprise an HNH domain having at least about 70% identity to any one of SEQ ID NOs: 4565-4727. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4565-4727. The endonuclease may comprise an HNH domain substantially identical to any one of SEQ ID NOs: 4565-4727. The endonuclease may comprise an HNH domain having at least about 70% identity to any one of SEQ ID NOs: 4565-4727. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4565-4727. The endonuclease may comprise an HNH domain substantially identical to any one of SEQ ID NOs: 4565-4727.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. In some cases, the endonuclease may be substantially identical to any one of SEQ ID NOs: 930-1092. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. In some cases, the endonuclease may be substantially identical to any one of SEQ ID NOs: 930-1092.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 930-1092, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 930-1092. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprise a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5506. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5506. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5506. The tracrRNA may comprise SEQ ID NO: 5506.

In some cases, the at least one engineered synthetic guide ribonucleic acid (sgRNA) capable of forming a complex with the endonuclease may comprise a sequence having at least about 80% identity to SEQ ID NO: 5470. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5470. The sgRNA may comprise a sequence substantially identical to SEQ ID NO: 5470.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2751-2913. The deoxyribonucleic acid (DNA) containing an open reading frame encoding said endonuclease may comprise a sequence substantially identical to SEQ ID NO: 5582 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5582. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG16 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 2914-3174. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2914-3174. In some cases, the endonuclease may comprise a RuvC_III domain, wherein the substantially identical to any one of SEQ ID NOs: 2914-3174. The endonuclease may comprise a RuvC_III domain having at least about 70% sequence identity to any one of SEQ ID NOs: 2914-3174. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 2914-3174. In some cases, the endonuclease may comprise a RuvC_III domain substantially identical to any one of SEQ ID NOs: 2914-3174.

The endonuclease may comprise an HNH domain having at least about 70% identity to any one of SEQ ID NOs: 4728-4988. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4728-4988. The endonuclease may comprise an HNH domain substantially identical to any one of SEQ ID NOs: 4728-4988. The endonuclease may comprise an HNH domain having at least about 70% identity to any one of SEQ ID NOs: 4728-4988. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4728-4988. The endonuclease may comprise an HNH domain substantially identical to any one of SEQ ID NOs: 4728-4988.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. In some cases, the endonuclease may be substantially identical to any one of SEQ ID NOs: 1093-1353. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. In some cases, the endonuclease may be substantially identical to any one of SEQ ID NOs: 1093-1353.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1093-1353, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1093-1353. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5507. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5507. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5507. The tracrRNA may comprise SEQ ID NO: 5507.

In some cases, the at least one engineered synthetic guide ribonucleic acid (sgRNA) capable of forming a complex with the endonuclease may comprise a sequence having at least about 80% identity to SEQ ID NO: 5471. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5471. The sgRNA may comprise a sequence substantially identical to SEQ ID NO: 5471.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 2914-3174. The deoxyribonucleic acid (DNA) containing an open reading frame encoding said endonuclease may comprise a sequence substantially identical to SEQ ID NO: 5583 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NO: 5583. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG18 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3175-3300. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3175-3300. In some cases, the endonuclease may comprise a RuvC_III domain, wherein the substantially identical to any one of SEQ ID NOs: 3175-3300. The endonuclease may comprise a RuvC_III domain having at least about 70% sequence identity to any one of SEQ ID NOs: 3175-3300. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3175-3300. In some cases, the endonuclease may comprise a RuvC_III domain substantially identical to any one of SEQ ID NOs: 3175-3300.

The endonuclease may comprise an HNH domain having at least about 70% identity to any one of SEQ ID NOs: 4989-5146. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4989-5146. The endonuclease may comprise an HNH domain substantially identical to any one of SEQ ID NOs: 4989-5146. The endonuclease may comprise an HNH domain having at least about 70% identity to any one of SEQ ID NOs: 4989-5146. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 4989-5146. The endonuclease may comprise an HNH domain substantially identical to any one of SEQ ID NOs: 4989-5146.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. In some cases, the endonuclease may be substantially identical to any one of SEQ ID NOs: 1354-1511. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. In some cases, the endonuclease may be substantially identical to any one of SEQ ID NOs: 1354-1511.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1354-1511, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1354-1511. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5508. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5508. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5508. The tracrRNA may comprise SEQ ID NO: 5508.

In some cases, the at least one engineered synthetic guide ribonucleic acid (sgRNA) capable of forming a complex with the endonuclease may comprise a sequence having at least about 80% identity to SEQ ID NO: 5472. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5472. The sgRNA may comprise a sequence substantially identical to SEQ ID NO: 5472.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3175-3300. The deoxyribonucleic acid (DNA) containing an open reading frame encoding said endonuclease may comprise a sequence substantially identical to SEQ ID NOs: 5584 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5584. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG21 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3331-3474. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3331-3474. In some cases, the endonuclease may comprise a RuvC_III domain, wherein the substantially identical to any one of SEQ ID NOs:

3331-3474. The endonuclease may comprise a RuvC_III domain having at least about 70% sequence identity to any one of SEQ ID NOs: 3331-3474. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3331-3474. In some cases, the endonuclease may comprise a RuvC_III domain substantially identical to any one of SEQ ID NOs: 3331-3474.

The endonuclease may comprise an HNH domain having at least about 70% identity to any one of SEQ ID NOs: 5147-5290. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5147-5290. The endonuclease may comprise an HNH domain substantially identical to any one of SEQ ID NOs: 5147-5290. The endonuclease may comprise an HNH domain having at least about 70% identity to any one of SEQ ID NOs: 5147-5290. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5147-5290. The endonuclease may comprise an HNH domain substantially identical to any one of SEQ ID NOs: 5147-5290.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. In some cases, the endonuclease may be substantially identical to any one of SEQ ID NOs: 1512-1655. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. In some cases, the endonuclease may be substantially identical to any one of SEQ ID NOs: 1512-1655.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1512-1655, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1512-1655. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5509. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5509. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5509. The tracrRNA may comprise SEQ ID NO: 5509.

In some cases, the at least one engineered synthetic guide ribonucleic acid (sgRNA) capable of forming a complex with the endonuclease may comprise a sequence having at least about 80% identity to SEQ ID NO: 5473. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5473. The sgRNA may comprise a sequence substantially identical to SEQ ID NO: 5473.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3331-3474. The deoxyribonucleic acid (DNA) containing an open reading frame encoding said endonuclease may comprise a sequence substantially identical to SEQ ID NOs: 5585 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5585. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG22 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3475-3568. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3475-3568. In some cases, the endonuclease may comprise a RuvC_III domain, wherein the substantially identical to any one of SEQ ID NOs: 3475-3568. The endonuclease may comprise a RuvC_III domain having at least about 70% sequence identity to any one of SEQ ID NOs: 3475-3568. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3475-3568. In some cases, the endonuclease may comprise a RuvC_III domain substantially identical to any one of SEQ ID NOs: 3475-3568.

The endonuclease may comprise an HNH domain having at least about 70% identity to any one of SEQ ID NOs: 5291-5389. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5291-5389. The endonuclease may comprise an HNH domain substantially identical to any one of SEQ ID NOs: 5291-5389. The endonuclease may comprise an HNH domain having at least about 70% identity to any one of SEQ ID NOs: 5291-5389. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5291-5389. The endonuclease may comprise an HNH domain substantially identical to any one of SEQ ID NOs: 5291-5389.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. In some cases, the endonuclease may be substantially identical to any one of SEQ ID NOs: 1656-1755. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. In some cases, the endonuclease may be substantially identical to any one of SEQ ID NOs: 1656-1755.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 432-660, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1656-1755. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5510. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5510. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5510. The tracrRNA may comprise SEQ ID NO: 5510.

In some cases, the at least one engineered synthetic guide ribonucleic acid (sgRNA) capable of forming a complex with the endonuclease may comprise a sequence having at least about 80% identity to SEQ ID NO: 5474. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO: 5474. The sgRNA may comprise a sequence substantially identical to SEQ ID NO: 5474.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3475-3568. The deoxyribonucleic acid (DNA) containing an open reading frame encoding said endonuclease may comprise a sequence substantially identical to SEQ ID NOs: 5586 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5586. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

MG23 Enzymes

In one aspect, the present disclosure provides for an engineered nuclease system comprising (a) an endonuclease. In some cases, the endonuclease is a Cas endonuclease. In some cases, the endonuclease is a Type II, Class II Cas endonuclease. The endonuclease may comprise a RuvC_III domain, wherein said RuvC_III domain has at least about 70% sequence identity to any one of SEQ ID NOs: 3569-3637. In some cases, the endonuclease may comprise a RuvC_III domain, wherein the RuvC_III domain has at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3569-3637. In some cases, the endonuclease may comprise a RuvC_III domain, wherein the substantially identical to any one of SEQ ID NOs: 3569-3637. The endonuclease may comprise a RuvC_III domain having at least about 70% sequence identity to any one of SEQ ID NOs: 3569-3637. In some cases, the endonuclease may comprise a RuvC_III domain having at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of SEQ ID NOs: 3569-3637. In some cases, the endonuclease may comprise a RuvC_III domain substantially identical to any one of SEQ ID NOs: 3569-3637.

The endonuclease may comprise an HNH domain having at least about 70% identity to any one of SEQ ID NOs: 5390-5460. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5390-5460. The endonuclease may comprise an HNH domain substantially identical to any one of SEQ ID NOs: 5390-5460. The endonuclease may comprise an HNH domain having at least about 70% identity to any one of SEQ ID NOs: 5390-5460. In some cases, the endonuclease may comprise an HNH domain having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to any one of SEQ ID NOs: 5390-5460. The endonuclease may comprise an HNH domain substantially identical to any one of SEQ ID NOs: 5390-5460.

In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1756-1826. In some cases, the endonuclease may be substantially identical to any one of SEQ ID NOs: 1756-1826. In some cases, the endonuclease may comprise a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to any one of SEQ ID NOs: 1756-1826. In some cases, the endonuclease may be substantially identical to any one of SEQ ID NOs: 1756-1826.

In some cases, the endonuclease may comprise a variant having one or more nuclear localization sequences (NLSs). The NLS may be proximal to the N- or C-terminus of said endonuclease. The NLS may be appended N-terminal or C-terminal to any one of SEQ ID NOs: 1756-1826, or to a variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, at least about 99% identity to any one of SEQ ID NOs: 1756-1826. The NLS may be an SV40 large T antigen NLS. The NLS may be a c-myc NLS. The NLS can comprise a sequence with at least about 80%, at least about 85%, at least about 90%, at least about 95%, at least about 99% identity to any one of SEQ ID NOs: 5593-5608. The NLS can comprise a sequence substantially identical to any one of SEQ ID NOs: 5593-5608. The NLS can comprise any of the sequences in Table 1 or a combination thereof.

In some cases, sequence identity may be determined by the BLASTP, CLUSTALW, MUSCLE, MAFFT, Novafold, or Smith-Waterman homology search algorithm. The sequence identity may be determined by the BLASTP algorithm using parameters of a wordlength (W) of 3, an expectation (E) of 10, and using a BLOSUM62 scoring matrix setting gap costs at existence of 11, extension of 1, and using a conditional compositional score matrix adjustment.

In some cases, the system above may comprise (b) at least one engineered synthetic guide ribonucleic acid (sgRNA) capable of forming a complex with the endonuclease bearing a 5' targeting region complementary to a desired cleavage sequence. In some cases, the 5' targeting region may comprises a PAM sequence compatible with the endonuclease. In some cases, the 5' most nucleotide of the targeting region may be G. In some cases, the 5' targeting region may be 15-23 nucleotides in length. The guide sequence and the tracr sequence may be supplied as separate ribonucleic acids (RNAs) or a single ribonucleic acid (RNA). The guide RNA may comprise a crRNA tracrRNA binding sequence 3' to the targeting region. The guide RNA may comprise a tracrRNA sequence preceded by a 4-nucleotide linker 3' to the crRNA tracrRNA binding region. The sgRNA may comprise, from 5' to 3': a non-natural guide nucleic acid sequence capable of hybridizing to a target sequence in a cell; and a tracr sequence. In some cases, the non-natural guide nucleic acid sequence and the tracr sequence are covalently linked.

In some cases, the tracr sequence may have a particular sequence. The tracr sequence may have at least about 80% to at least about 60-100 (e.g., at least about 60, at least about 65, at least about 70, at least about 75, at least about 80, at least about 85, or at least about 90) consecutive nucleotides of a natural tracrRNA sequence. The tracr sequence may have at least about 80% sequence identity to at least about 60-100 (e.g., at least about 60, at least about 65, at least about 70, at least about 75, at least about 80, at least about 85, or at least about 90) consecutive nucleotides of SEQ ID NO: 5511. In some cases, the tracrRNA may have at least about 80%, at least about 85%, at least about 90%, at least about 91%, at least about 92%, at least about 93%, at least about 94%, at least about 95%, at least about 96%, at least about 97%, at least about 98%, or at least about 99% identity to at least about 60-90 (e.g., at least about 60, at least about 65, at least about 70, at least about 75, at least about 80, at least about 85, or at least about 90) consecutive nucleotides of SEQ ID NO: 5511. In some cases, the tracrRNA may be substantially identical to at least about 60-100 (e.g., at least about 60, at least about 65, at least about 70, at least about 75, at least about 80, at least about 85, or at least about 90) consecutive nucleotides of SEQ ID NO: 5511. The tracrRNA may comprise SEQ ID NO: 5511.

In some cases, the at least one engineered synthetic guide ribonucleic acid (sgRNA) capable of forming a complex with the endonuclease may comprise a sequence having at least about 80% identity to SEQ ID NO: 5475. The sgRNA may comprise a sequence having at least about 80%, at least about 85%, at least about 90%, at least about 91%, at least about 92%, at least about 93%, at least about 94%, at least about 95%, at least about 96%, at least about 97%, at least about 98%, or at least about 99% identity to SEQ ID NO:

5475. The sgRNA may comprise a sequence substantially identical to SEQ ID NO: 5475.

In some cases, the system above may comprise two different sgRNAs targeting a first region and a second region for cleavage in a target DNA locus, wherein the second region is 3' to the first region. In some cases, the system above may comprise a single- or double-stranded DNA repair template comprising from 5' to 3': a first homology arm comprising a sequence of at least about 20 (e.g., at least about 40, 80, 120, 150, 200, 300, 500, or 1 kb) nucleotides 5' to the first region, a synthetic DNA sequence of at least about 10 nucleotides, and a second homology arm comprising a sequence of at least about 20 (e.g., at least about 40, 80, 120, 150, 200, 300, 500, or 1 kb) nucleotides 3' to the second region.

In another aspect, the present disclosure provides a method for modifying a target nucleic acid locus of interest. The method may comprise delivering to the target nucleic acid locus any of the non-natural systems disclosed herein, including an enzyme and at least one synthetic guide RNA (sgRNA) disclosed herein. The enzyme may form a complex with the at least one sgRNA, and upon binding of the complex to the target nucleic acid locus of interest, may modify the target nucleic acid locus of interest. Delivering the enzyme to said locus may comprise transfecting a cell with the system or nucleic acids encoding the system. Delivering the nuclease to said locus may comprise electroporating a cell with the system or nucleic acids encoding the system. Delivering the nuclease to said locus may comprise incubating the system in a buffer with a nucleic acid comprising the locus of interest. In some cases, the target nucleic acid locus comprises deoxyribonucleic acid (DNA) or ribonucleic acid (RNA). The target nucleic acid locus may comprise genomic DNA, viral DNA, viral RNA, or bacterial DNA. The target nucleic acid locus may be within a cell. The target nucleic acid locus may be in vitro. The target nucleic acid locus may be within a eukaryotic cell or a prokaryotic cell. The cell may be an animal cell, a human cell, bacterial cell, archaeal cell, or a plant cell. The enzyme may induce a single or double-stranded break at or proximal to the target locus of interest.

In cases where the target nucleic acid locus may be within a cell, the enzyme may be supplied as a nucleic acid containing an open reading frame encoding the enzyme having a RuvC_III domain having at least about 75% (e.g., at least about 90%, at least about 91%, at least about 92%, at least about 93%, at least about 94%, at least about 95%, at least about 96%, at least about 97%, at least about 98%, at least about 99%) identity to any one of SEQ ID NOs: 3569-3637. The deoxyribonucleic acid (DNA) containing an open reading frame encoding said endonuclease may comprise a sequence substantially identical to SEQ ID NOs: 5587 or at variant having at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% identity to SEQ ID NOs: 5587. In some cases, the nucleic acid comprises a promoter to which the open reading frame encoding the endonuclease is operably linked. The promoter may be a CMV, EF1a, SV40, PGK1, Ubc, human beta actin, CAG, TRE, or CaMKIIa promoter. The endonuclease may be supplied as a capped mRNA containing said open reading frame encoding said endonuclease. The endonuclease may be supplied as a translated polypeptide. The at least one engineered sgRNA may be supplied as deoxyribonucleic acid (DNA) containing a gene sequence encoding said at least one engineered sgRNA operably linked to a ribonucleic acid (RNA) pol III promoter. In some cases, the organism may be eukaryotic. In some cases, the organism may be fungal. In some cases, the organism may be human.

EXAMPLES

Example 1—Metagenomic Analysis for New Proteins

Metagenomic samples were collected from sediment, soil and animal. Deoxyribonucleic acid (DNA) was extracted with a Zymobiomics DNA mini-prep kit and sequenced on an Illumina HiSeq® 2500. Samples were collected with consent of property owners. Additional raw sequence data from public sources included animal microbiomes, sediment, soil, hot springs, hydrothermal vents, marine, peat bogs, permafrost, and sewage sequences. Metagenomic sequence data was searched using Hidden Markov Models generated based on known Cas protein sequences including type II Cas effector proteins. Novel effector proteins identified by the search were aligned to known proteins to identify potential active sites. This metagenomic workflow resulted in delineation of the MGT, MG2, MG3, MG4, MG6, MG14, MG15, MG16, MG18, MG21, MG22, and MG23 families of class II, type II CRISPR endonucleases described herein.

Example 2A—Discovery of an MG1 Family of CRISPR Systems

Analysis of the data from the metagenomic analysis of Example 1 revealed a new cluster of previously undescribed putative CRISPR systems initially comprising six members (MGT-1, MGT-2, MGT-3, MGT-4, MGT-5, and MGT-6 recorded as SEQ ID NOs: 5, 6, 1, 2, and 3 respectively). This family is characterized by an enzyme bearing HNH and RuvC domains. The RuvC domains of this family have a RuvC III portion having low homology to previously described Cas9 family members. Although the initial family members have a maximum of 56.8% identity among them, all 6 enzymes exhibit a divergent RuvC_III portion of the RuvC domain and bear the common motif of RHHAL-DAMV (SEQ ID NO:5615), KHHALDAMC (SEQ ID NO:5616), or KHHALDAIC (SEQ ID NO:5617). These motifs are not found in other described Cas9-like enzymes. The corresponding protein and nucleic acid sequences for these new enzymes and their relevant subdomains are presented in the sequence listing. Putative tracrRNA sequences were identified based on their location relative to the other genes and are presented as SEQ ID NOs: 5476-5479. The enzyme systems appear to derive from the Phylum Verrucomicrobia, the Phylum Candidatus Peregrinibacteria, or the Phylum Candidatus Melainabacteria based on the sequences of 16S rRNAs from genome bins containing the CRISPR systems. The 16S rRNA sequences are presented as SEQ ID NOs: 5592-5596). A detailed domain-level alignment of the CRISPR system sequences together calling out the features described by Shmakov et al. (Mol Cell. 2015 Nov. 5; 60(3):385-97), which is entirely incorporated by reference) is depicted in FIGS. 9A, 9B, 9C, 9D, 9E, 9F, 9G, and 9H. A comparison of MG1-1, 1-2, and 1-3 versus additional proprietary protein datasets revealed additional protein sequences with similar architecture, presented as SEQ NOs:

7-319. These MG1 protein sequences led to the discovery of additional MG1 motifs as shown in SEQ ID NOs: 5618-5632.

Example 2B—Discovery of an MG2 Family of CRISPR Systems

Analysis of data from the metagenomic analysis of Example 1 revealed a new cluster of previously undescribed putative CRISPR systems comprising six members (MG2-1, MG2-2, MG2-3, MG2-5, and MG2-6). The corresponding protein and nucleic acid sequences for these new enzymes and exemplary subdomains are presented as SEQ ID NOs: 320, 322-325. Based on their location relative to the other genes, putative tracrRNA sequences were identified in the operon and are presented as SEQ ID NOs: 5490, 5492-5494, and 5538. A detailed domain-level alignment of these sequences versus Cas9 as outlined in Shmakov et al. (Mol Cell. 2015 Nov. 5; 60(3):385-97.), is depicted in FIG. 7.

A comparison of MG2-1, MG2-2, MG2-3, MG2-5, and MG2-6 versus additional proprietary protein datasets revealed additional protein sequences with similar architecture, presented as SEQ NOs: 321 and 326-420. Motifs commonly found in MG2 family members are presented as SEQ ID NOs: 5631-5638.

Example 2C—Discovery of an MG3 Family of CRISPR Systems

Analysis of the data from the metagenomic analysis of Example 1 revealed a new previously undescribed putative CRISPR system: MG3-1. The corresponding amino acid sequences for this new enzyme and its exemplary subdomains are presented as SEQ ID NOs: 424, 2245, and 4059. Based on proximity to the other elements in the operon, a putative tracrRNA containing sequence was identified and is included as SEQ ID NO: 5498. A detailed domain-level alignment of the sequence versus Cas9 from *Actinomyces naeslundii* is depicted in FIG. 8.

A comparison of MG3-1 versus additional proprietary protein datasets revealed additional protein sequences with similar architecture, presented as SEQ NOs: 421-423, 425-431.

Example 2D—Discovery of MG4, 7, 14, 15, 16, 18, 21, 22, 23 Families of CRISPR Systems Analysis of the data from the metagenomic analysis of Example 1 revealed new clusters of previously undescribed putative CRISPR systems comprising 9 families of one member each (MG 4-5, MG7-2, MG14-1, MG15-1, MG16-2, MG18-1, MG21-1, MG22-1, MG23-1). The corresponding protein and nucleic acid sequences for these new enzymes and their exemplary subdomains are presented as SEQ ID NOs: 432, 669, 678, 930, 1093, 1354, 1512, 1656, 1756. Based on proximity to the other elements in the operon, a putative tracr containing sequence was identified for each family. These sequences are presented in the sequence listing as SEQ ID NOs: 5503-5511, respectively.

A comparison of MG 4-5, MG7-2, MG14-1, MG15-1, MG16-2, MG18-1, MG21-1, MG22-1, MG23-1 versus additional proprietary protein datasets revealed additional protein sequences with similar architecture, presented as SEQ NOs: 433-660, 670-677, 679-929, 931-1092, 1094-1353, 1355-1511, 1513-1655, 1657-1755, and 1757-1826. Motifs common to the nucleases of these sets of CRISPR systems are presented as SEQ ID NO: 5649 for MG4; SEQ ID NOs: 5650-5667 for MG14; 5668-5675 for MG15; SEQ ID NOs: 5676-5678 for MG16; SEQ ID NOs: 5679-5686 for MG18; SEQ ID NOs: 5687-5693 and SEQ ID NOs: 5674-5675 for MG21; SEQ ID NOs: 5694-5699 for MG22; and SEQ ID NOs: 5700-5717 for MG23.

Example 3—Prophetic—Determination of Protospacer-Adjacent Motif

Experiments are performed as in any of the examples in Karvelis et al. Methods. 2017 May 15; 121-122:3-8, which is entirely incorporated by reference herein, to identify the protospacer adjacent motif (PAM) sequence specificity for the novel enzymes described herein to allow for optimal synthetic sequence targeting.

In one example (in-vivo screen), cells bearing plasmids encoding any of the enzymes described herein and proto-spacer-targeting guide RNA are co-transformed with a plasmid library containing an antibiotic resistance gene, and a protospacer sequence flanked by a randomized PAM sequence. Plasmids containing functional PAMs are cleaved by the enzyme, leading to cell death. Deep-sequencing of the enzyme cleavage-resistant plasmid pool isolated from the surviving cells displays a set of depleted plasmids that contain functional cleavage-permitting PAMs.

In another example (in vitro screen), PAM library in the form of DNA plasmid or concatemeric repeats is subjected to cleavage by the RNP complex (e.g., including the enzyme, tracrRNA and crRNA or the enzyme and hybrid sgRNA) assembled in vitro or in cell lysates. Resulting free DNA ends from successful cleavage events are captured by adapter ligation, followed by the PCR amplification of the PAM-sided products. Amplified library of functional PAMs is subjected to deep sequencing and PAMs licensing DNA cleavage are identified.

Example 4—Prophetic-Use of Synthetic CRISPR System as Described Herein in a Mammalian Cell for Genome Editing DNA/RNA sequences encoding (i) an ORF encoding codon-optimized enzyme under a cell-compatible promoter with a cell-compatible C-terminal nuclear localization sequence (e.g., SV40 NLS in the case of human cells) and a suitable polyadenylation signal (e.g., TK pA signal in the case of human cells); and (ii) an ORF encoding an sgRNA (having a 5' sequence beginning with G followed by 20 nt of a complementary targeting nucleic acid sequence targeting genomic DNA followed by a corresponding compatible PAM identified via Example 3 and a 3' tracr-binding sequence, a linker, and the tracrRNA sequence) under a suitable Polymerase III promoter (e.g., the U6 promoter in mammalian cells) are prepared. In some embodiments, these sequences are prepared on the same or separate plasmid vectors, which are transfected via a suitable technique into eukaryotic cells. In some embodiments, these sequences are prepared as separate DNA sequences, which are transfected or microinjected into cells. In some embodiments, these sequences are prepared as synthesized RNAs or in-vitro transcribed RNAs which are transfected or microinjected into cells. In some embodiments, these sequences are translated into proteins and transfected or microinjected into cells.

Whichever transfection method is selected, (i) and (ii) are introduced into cells. A period of incubation is allowed to pass so that the enzyme and/or sgRNA can be transcribed and/or translated into active form. After the incubation period, genomic DNA in the vicinity of the targeting sequence is analyzed (e.g., by sequencing). An indel is introduced into the genomic DNA in the vicinity of the targeting sequence as a result of enzyme-mediated cleavage and non-homologous end joining.

In some embodiments, (i) and (ii) are introduced into cells with a third repair nucleotide that encodes regions of the genome flanking the cleavage site of sizes 25 bp or larger, which will facilitate homology directed repair. Containing within these flanking sequences may be a single base pair mutation, a functional gene fragment, a foreign or native gene for expression, or several genes composing a bio-chemical pathway.

Example 5—Prophetic-Use of Synthetic CRISPR System as Described Herein In Vitro Any of the enzymes described herein are cloned into a suitable *E. coli* expression plasmid containing a purification tag and are recombinantly expressed in *E. coli* and purified using the recombinant tag. RNAs comprising a 5' G fol-lowed by a 20 nt targeting sequence and PAM sequence, a tracrRNA binding region of a compatible crRNA, a GAAA linker, and a compatible tracrRNA are synthesized by suit-able solid-phase RNA synthesis methods. Recombinant enzymes and sgRNA are combined in a suitable cleavage buffer containing Mg2+ (e.g., 20 mM HEPES pH 7.5, 100 mM KCl, 5 mM MgCl$_2$, 1 mM DTT, 5% glycerol) and the reaction is initiated by introducing a target DNA including a sequence complementary to the targeting sequence and PAM sequence. Cleavage of the DNA is monitored by a suitable assay (e.g., agarose gel electrophoresis followed by ethidium bromide staining (or similarly acting DNA-inter-calating agent) and UV visualization).

Example 6—(General Protocol) PAM Sequence Identification/Confirmation for the Endonucleases Described Herein PAM sequences were determined by sequencing plasmids containing randomly-generated PAM sequences that could be cleaved by putative endonucleases expressed in an *E. coli* lysate-based expression system (myTXTL, Arbor Biosci-ences). In this system, an *E. coli* codon optimized nucleotide sequence was transcribed and translated from a PCR frag-ment under control of a T7 promoter. A second PCR fragment with a tracr sequence under a T7 promoter and a minimal CRISPR array composed of a T7 promoter fol-lowed by a repeat-spacer-repeat sequence was transcribed in the same reaction. Successful expression of the endonu-clease and tracr sequence in the TXTL system followed by CRISPR array processing provided active in vitro CRISPR nuclease complexes.

A library of target plasmids containing a spacer sequence matching that in the minimal array followed by 8N mixed bases (putative PAM sequences) was incubated with the output of the TXTL reaction. After 1-3 hr, the reaction was stopped and the DNA was recovered via a DNA clean-up kit, e.g., Zymo DCC, AMPure XP beads, QiaQuick etc. Adapter sequences were blunt-end ligated to DNA with active PAM sequences that had been cleaved by the endonuclease, whereas DNA that had not been cleaved was inaccessible for ligation. DNA segments comprising active PAM sequences were then amplified by PCR with primers specific to the library and the adapter sequence. The PCR amplification products were resolved on a gel to identify amplicons that corresponded to cleavage events. The amplified segments of the cleavage reaction were also used as template for prepa-ration of an NGS library. Sequencing this resulting library, which was a subset of the starting 8N library, revealed the sequences which contain the correct PAM for the active CRISPR complex. For PAM testing with a single RNA construct, the same procedure was repeated except that an in vitro transcribed RNA was added along with the plasmid library and the tracr/minimal CRISPR array template was omitted. For endonucleases where NGS libraries were pre-pared, seqLogo (see e.g., Huber et al. Nat Methods. 2015 February; 12(2):115-21) representations were constructed and are presented in FIGS. 27, 38, 29, 30, 31, 32, 33, 34, and 35. The seqLogo module used to construct these represen-tations takes the position weight matrix of a DNA sequence motif (e.g. a PAM sequence) and plots the corresponding sequence logo as introduced by Schneider and Stephens (see e.g. Schneider et al. Nucleic Acids Res. 1990 Oct. 25; 18(20):6097-100. The characters representing the sequence in the seqLogo representations have been stacked on top of each other for each position in the aligned sequences (e.g. PAM sequences). The height of each letter is proportional to its frequency, and the letters have been sorted so the most common one is on top.

Example 7—(General Protocol) RNA Folding of tracrRNA and sgRNA Structures

Folded structures of guide RNA sequences at 37° C. were computed using the method of Andronescu et al. Bioinfor-matics. 2007 Jul. 1; 23(13):i19-28, which is incorporated by reference herein in its entirety. Predicted structures of exem-plary sgRNAs described herein are presented in FIGS. 21, 22, 23, 24, 25, and 26.

Example 8—(General Protocol) In Vitro Cleavage Efficiency of MG CRISPR Complexes Endonucleases were expressed as His-tagged fusion pro-teins from an inducible T7 promoter in a protease deficient *E. coli* B strain. Cells expressing the His-tagged proteins were lysed by sonication and the His-tagged proteins were purified by Ni-NTA affinity chromatography on a HisTrap FF column (GE Lifescience) on an AKTA Avant FPLC (GE Lifescience). The eluate was resolved by SDS-PAGE on acrylamide gels (Bio-Rad) and stained with InstantBlue Ultrafast coomassie (Sigma-Aldrich). Purity was deter-mined using densitometry of the protein band with Image-Lab software (Bio-Rad). Purified endonucleases were dia-lyzed into a storage buffer composed of 50 mM Tris-HCl, 300 mM NaCl, 1 mM TCEP, 5% glycerol; pH 7.5 and stored at −80° C.

Target DNAs containing spacer sequences and PAM sequences (determined e.g., as in Example 6) were con-structed by DNA synthesis. A single representative PAM was chosen for testing when the PAM had degenerate bases. The target DNAs comprised 2200 bp of linear DNA derived from a plasmid via PCR amplification with a PAM and spacer located 700 bp from one end. Successful cleavage resulted in fragments of 700 and 1500 bp. The target DNA, in vitro transcribed single RNA, and purified recombinant protein were combined in cleavage buffer (10 mM Tris, 100 mM NaCl, 10 mM MgCl$_2$) with an excess of protein and RNA and incubated for 5 minutes to 3 hours, usually 1 hr. The reaction was stopped via addition of RNAse A and incubation at 60 minutes. The reaction was then resolved on a 1.2% TAE agarose gel and the fraction of cleaved target DNA is quantified in ImageLab software.

Example 9—(General Protocol) Testing of Genome Cleavage Activity of MG CRISPR Complexes in E. coli

*E. coli* lacks the capacity to efficiently repair double-stranded DNA breaks. Thus, cleavage of genomic DNA can be a lethal event. Exploiting this phenomenon, endonuclease activity was tested in *E. coli* by recombinantly expressing an endonuclease and a tracrRNA in a target strain with spacer/target and PAM sequences integrated into its genomic DNA.

In this assay, the PAM sequence is specific for the endonuclease being tested as determined by the methods described in Example 6. sgRNA sequences were determined based upon the sequence and predicted structure of the tracrRNA. Repeat-anti-repeat pairings of 8-12 bp (generally 10 bp) were chosen, starting from the 5' end of the repeat. The remaining 3' end of the repeat and 5' end of the tracrRNA were replaced with a tetraloop. Generally, the tetraloop was GAAA, but other tetraloops can be used, particularly if the GAAA sequence is predicted to interfere with folding. In these cases, a TTCG tetraloop was used.

Engineered strains with PAM sequences integrated into their genomic DNA were transformed with DNA encoding the endonuclease. Transformants were then made chemo-competent and transformed with 50 ng of single guide RNAs either specific to the target sequence ("on target"), or non-specific to the target ("non target"). After heat shock, trans-formations were recovered in SOC for 2 hrs at 37° C. Nuclease efficiency was then determined by a 5-fold dilution series grown on induction media. Colonies were quantified from the dilution series in triplicate.

Example 10a—(General Protocol) Testing of Genome Cleavage Activity of MG CRISPR Complexes in Mammalian Cells To show targeting and cleavage activity in mammalian cells, the MG Cas effector protein sequences were tested in two mammalian expression vectors: (a) one with a C-terminal SV40 NLS and a 2A-GFP tag, and (b) one with no GFP tag and two SV40 NLS sequences, one on the N-terminus and one on the C-terminus. In some instances, nucleo-tide sequences encoding the endonucleases were codon-optimized for expression in mammalian cells.

The corresponding single guide RNA sequence (sgRNA) with targeting sequence attached is cloned into a second mammalian expression vector. The two plasmids are cotransfected into HEK293T cells. 72 hr after co-transfec-tion of the expression plasmid and a sgRNA targeting plasmid into HEK293T cells, the DNA is extracted and used for the preparation of an NGS-library. Percent NHEJ is measured via indels in the sequencing of the target site to demonstrate the targeting efficiency of the enzyme in mam-malian cells. At least 10 different target sites were chosen to test each protein's activity.

Example 10b. (General Protocol) Testing of Genome Cleavage Activity of MG CRISPR Complexes in Mammalian Cells To show targeting and cleavage activity in mammalian cells, the MG Cas effector protein sequences were cloned into two mammalian expression vector: (a) one with flank-ing N and C-terminal SV40 NLS sequences, a C-terminal His tag, and a 2A-GFP tag at the C terminus after the His tag (Backbone 1), and (b) one with flanking NLS sequences and C-terminal His tag but no T2A GFP tag (Backbone 2). In some instances, nucleotide sequences encoding the endonu-cleases were the native sequence, codon-optimized for expression in *E. coli*, or codon-optimized for expression in mammalian cells.

The corresponding single guide RNA sequence (sgRNA) with targeting sequence attached was cloned into a second mammalian expression vector. The two plasmids were cotransfected into HEK293T cells. 72 hr after co-transfec-tion of the expression plasmid and a sgRNA targeting plasmid into HEK293T cells, the DNA was extracted and used for the preparation of an NGS-library. Percent NHEJ was measured via indels in the sequencing of the target site to demonstrate the targeting efficiency of the enzyme in mammalian cells. About 7-12 different target sites were chosen for testing each protein's activity. An arbitrary threshold of 5% indels was used to identify active candi-dates.

Example 11—Characterization of MG1 Family Members

PAM Specificity, tracrRNA/sgRNA Validation

The targeted endonuclease activity of MG1 family endo-nuclease systems was confirmed using the myTXTL system described in Example 6. In this assay, PCR amplification of cleaved target plasmids yields a product that migrates at approximately 170 bp in the gel, as shown in FIGS. 17-20. Amplification products were observed for MG1-4 (dual guide: see gel 1, lane 3, single guide: see gel 6 lane 2), MG1-5 (gel 2 lane 10), MG1-6 (dual guide: see gel 5 lane 6, single guide see: gel 6 lane 5), and MG1-7 (dual guide: see gel 3 lane 13, single guide: see gel 3 lane 2) (protein SEQ ID NOs: 1-4, respectively). Sequencing the PCR products revealed active PAM sequences for these enzymes as shown in Table 2.

TABLE 2

| | | | | | | | |
|---|---|---|---|---|---|---|---|
| PAM sequence specificities and related data for MG1 enzymes | | | | | | | |
| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
| MG1-4 | 1 | nRRRAA | 5527 | 5476 | 5461 | nRRR | 5512 |
| MG1-5 | 2 | nnnnCC | 5528 | 5477 | 5462 | nnnnYY | 5513 |
| MG1-6 | 3 | nnRRAC | 5529 | 5478 | 5463 | nnRRAY | 5514 |
| MG1-7 | 4 | nRRRAA | 5530 | 5479 | 5464 | nRRRAAG | 5515 |

Synthetic single guide RNAs (sgRNAs) were designed based on the sequences and predicted structures of the tracrRNAs and are presented as SEQ ID NOs: 5461-5464. The PAM sequence screen of Example 6 was repeated with the sgRNAs. The results of this experiment are also presented in Table 2, which reveals that PAM specificity changed slightly when using sgRNAs.

Targeted Endonuclease Activity In Vitro

Figure 10:
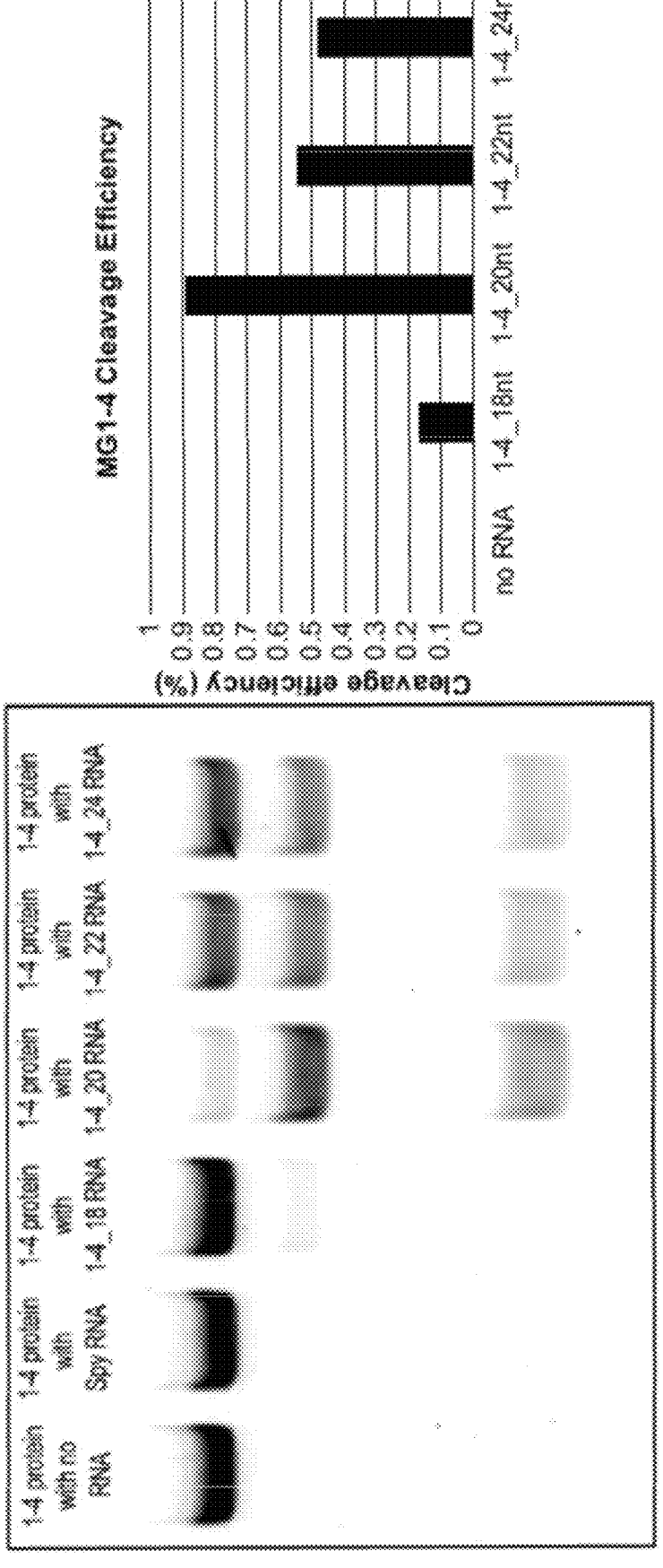
FIG. 10 depicts in vitro cleavage of DNA by MG1-4 in complex with its corresponding sgRNA containing targeting sequences of varying lengths.

In vitro activity of the MG1-4 endonuclease system (protein SEQ ID NO: 1 with sgRNA SEQ ID NO: 5461) on a target DNA with a PAM sequence CAGGAAGG was verified using the method of Example 8. The single guide sequence reported above (SEQ ID NO: 5461) was used, with varying spacer/targeting sequence lengths from 18-24 nt replacing the Ns of the sequence. The results are shown in FIG. 10, wherein the left panel shows a gel demonstrating DNA cleavage by MG1-4 in combination with corresponding single guide sgRNAs having different targeting sequence lengths (18-24 nt), and the right panel shows the same data quantified as a bar graph. The data demonstrated that targeting sequences from 18-24 nucleotides were functional with the MG1-4/sgRNA system.

Targeted Endonuclease Activity in Bacterial Cells

In vivo activity of the MG1-4 endonuclease system (protein SEQ ID NO: 1, sgRNA SEQ ID NO: 5461) was tested with the PAM sequence CAGGAAGG as in Example 9. Transformed *E. coli* were plated in serial dilution, and the results (showing *E. coli* serial dilutions in the left panel and quantitated growth in the right panel) are presented in FIG.

11. A substantial reduction in the growth of *E. coli* expressing on target sgRNA compared to *E. coli* expressing non-target sgRNA indicates that genomic DNA was specifically cleaved by the endonuclease in *E. coli* cells.

Targeted Endonuclease Activity in Mammalian Cells (a)

The method of Example 10 was used to demonstrate targeting and cleavage activity in mammalian cells. Open reading frames encoding the MG1-4 (protein SEQ ID NO: 5527) and MG1-6 (protein SEQ ID NO: 5529) sequences were cloned into 2 mammalian expression vectors, one with a C-terminal SV40 NLS and a 2A-GFP tag (*E. coli* MG-BB) and one with no GFP tag and 2 NLS sequences, one on the N-terminus and one on the C-terminus (*E. coli* pMG5-BB). For MG1-6, the open reading frame was additionally codon-optimized for mammalian expression (SEQ ID NO: 5589) and cloned into the 2-NLS plasmid backbone (MG-16 hs). The results of this experiment are shown in FIG. 12. The endonuclease expression vectors were cotransfected into HEK293T cells with a second vector for expressing a sgRNA (e.g., SEQ ID NOs: 5512 or 5515) with a tracr sequence specific for the endonuclease and a guide sequence selected from Tables 3-4. 72 hr after co-transfection the DNA was extracted and used for the preparation of an NGS-library. Cleavage activity was detected by the appearance of internal deletions (NHEJ remnants) proximal to the sequence of the target site. Percent NHEJ was measured via indels in the sequencing of the target site to demonstrate the targeting efficiency of the enzyme in mammalian cells and is presented in FIG. 12.

TABLE 3

MG1-4 mammalian targeting sequences

| MG1-4 Target ID | MG1-4 Targeting Sequence | Targeting sequence SEQ ID NO: | Targeted Gene |
|---|---|---|---|
| 1 | aatatgtagctgtttgggaggt | 5543 | VEGFA |
| 2 | ctaggggcgctcggccaccac | 5544 | VEGFA |
| 3 | tggctaaagagggaatgggctt | 5545 | VEGFA |
| 4 | cacaccccggctctggctaaag | 5546 | VEGFA |
| 5 | tcggaggagccgtggtccgcgc | 5547 | VEGFA |
| 6 | gcggaccacggctcctccgaag | 5548 | VEGFA |
| 7 | gtacaaacggcagaagctggag | 5549 | EMX1 |
| 8 | gaggaagggcctgagtccgagca | 5550 | EMX1 |
| 9 | aaggcaaacatcctgataatgg | 5551 | Apolipoprotein |

TABLE 4

MG1-6 mammalian targeting sequences

| MG1-6 Target ID | MG1-6 Targeting Sequence | Targeting sequence SEQ ID NO: | Targeted Gene |
|---|---|---|---|
| 1 | tctttagccagagccggggtgt | 5552 | VEGFA |
| 2 | tggacccctatttctgacctc | 5553 | VEGFA |
| 3 | atgggagcccttcttcttctgc | 5554 | EMX1 |
| 4 | tgccacgaagcaggccaatggg | 5555 | EMX1 |
| 5 | tggtgtctgtttgaggttgcta | 5556 | HBB-R01 |

TABLE 4-continued

| MG1-6 mammalian targeting sequences | | | |
|---|---|---|---|
| MG1-6 Target ID | MG1-6 Targeting Sequence | Targeting sequence SEQ ID NO: | Targeted Gene |
| 6 | gggcaggttggtatcaaggtta | 5557 | HBB-R01 |
| 7 | aggtgctgacgtaggtagtgct | 5558 | FANCF |
| 8 | gccctacttccgctttcacctt | 5559 | FANCF |
| 9 | aatgtatgctggcttttaaggg | 5560 | IVS40 |
| 10 | gctcctttggctagggaagtgt | 5561 | IVS40 |

Targeted Endonuclease Activity in Mammalian Cells (b)

Figure 37:
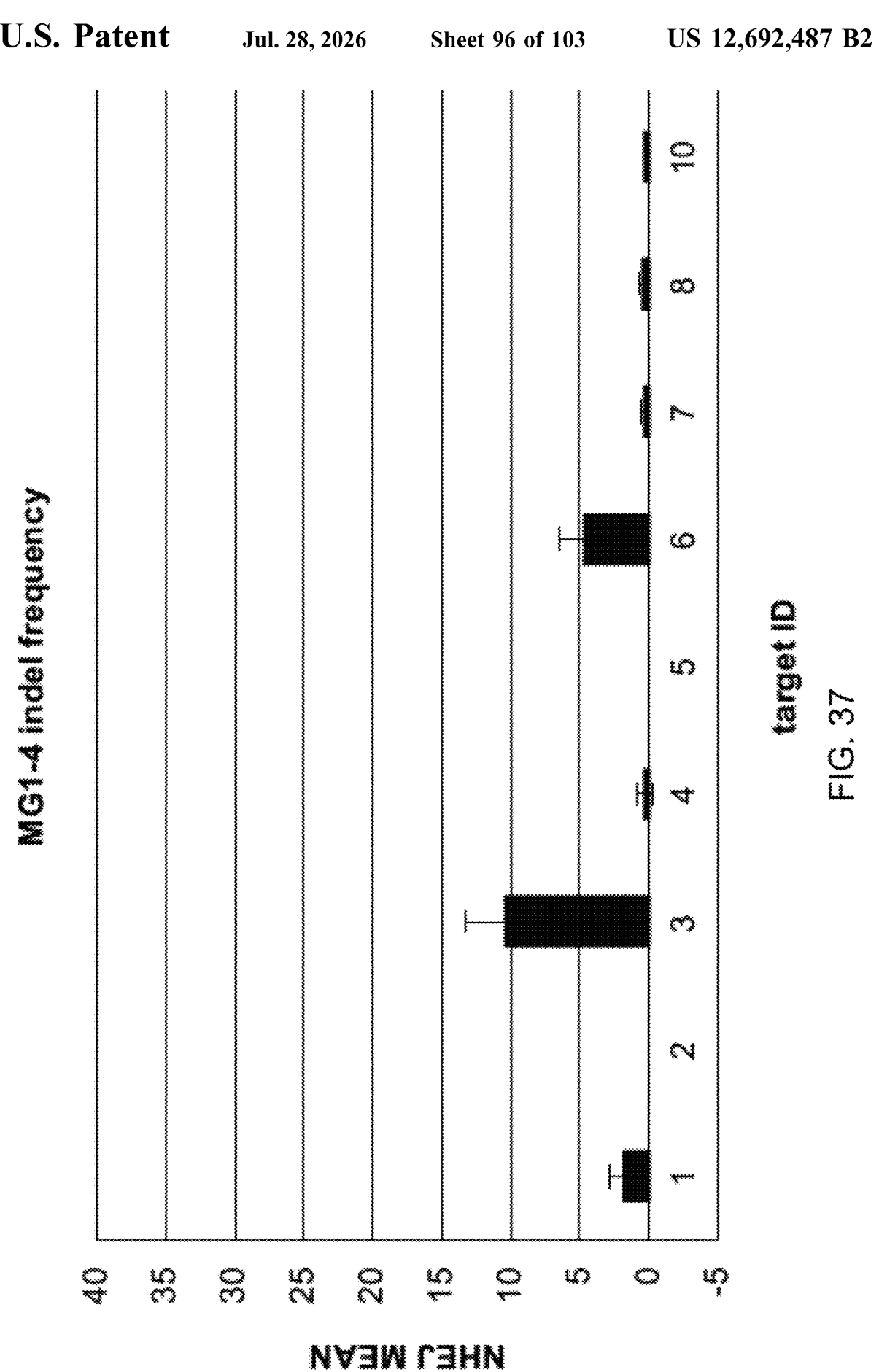
FIGS. 37-39 depicts in cell indel formation generated by transfection of HEK cells with MG1-4, MG1-6 and MG1-7 constructs described in Example 11 alongside their corresponding sgRNAs containing various different targeting sequences targeting various locations in the human genome.
Figure 38:
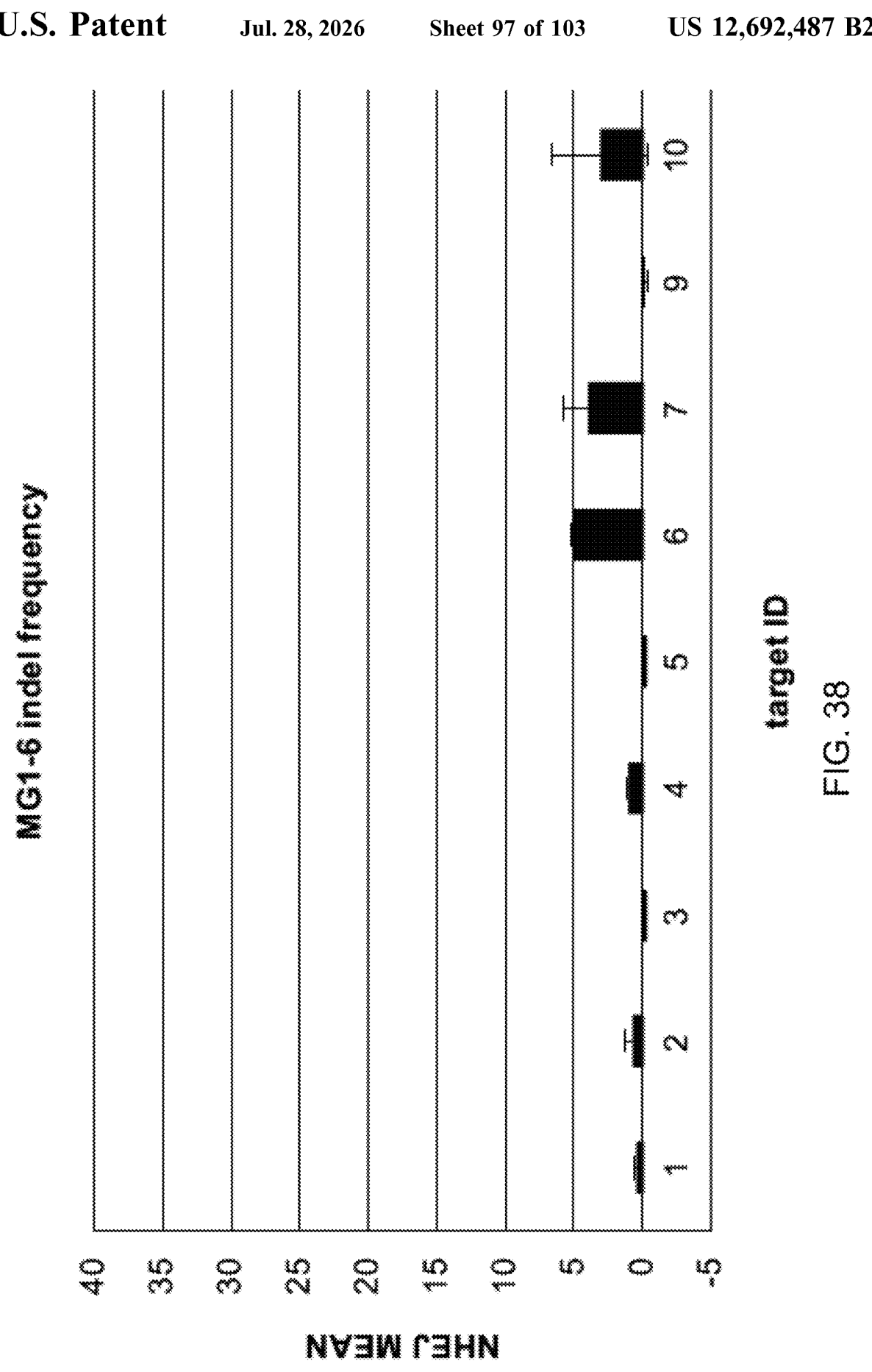

MG1-4 target loci were chosen to test locations in the genome with the PAM nRRRAA (SEQ ID NO: 5527). The spacers corresponding to the chosen target sites were cloned into the sgRNA scaffold in the mammalian vector system Backbone 2 described in Example 10b. The sites are listed in Table 4a below. The activity of MG1-4 at various target sites is shown in Table 4a and FIG. 37

TABLE 4a

| Activity of MG1-4 at various target sites | | | | | |
|---|---|---|---|---|---|
| target ID | target sequence | Target sequence SEQ ID NO: | PAM | locus | % NHEJ (mean ± std) |
| 1 | aatatgtagctgtttgggaggt | 5543 | CAGAAA | VEGFA | 1.62 ± 1.2 |
| 2 | ctaggggcgctcggccaccac | 5544 | AGGGAA | VEGFA | -0.07 ± 0 |
| 3 | tggctaaagagggaatgggctt | 5545 | TGGAAA | VEGFA | 10.32 ± 2.75 |
| 4 | cacaccccggctctggctaaag | 5546 | AGGGAA | VEGFA | 0.18 ± 0.53 |
| 5 | tcggaggagccgtggtccgcgc | 5547 | GGGGAA | VEGFA | 0 ± 0.03 |
| 6 | gaagccgagccgagcggagccg | 5719 | CGAGAA | VEGFA | 4.53 ± 1.73 |
| 7 | gcggaccacggctcctccgaag | 5548 | GAGGAA | VEGFA | 0.3 ± 0.04 |
| 8 | gtacaaacggcagaagctggag | 5549 | GAAGAA | EMX1 | 0.23 ± 0.1 |
| 10 | Gaaggcaaacatcctgataatgg | 5720 | TGAAAA | Apolipoprotein | 0.07 ± 0.06 |

MG1-6 target loci were chosen to test locations in the genome with the PAM nnRRAC (SEQ ID NO: 5529). The spacers corresponding to the chosen target sites were cloned into the sgRNA scaffold in the mammalian vector system backbone 2 described in Example 10b. The sites are listed in Table 4b below. The activity of MG1-6 at various target sites is shown in Table 4b and FIG. 38.

TABLE 4b

| Activity of MG1-6 at various target sites. | | | | | |
|---|---|---|---|---|---|
| target ID | target sequence | Target sequence SEQ ID NO: | PAM | locus | % NHEJ (mean ± std) |
| 1 | tctttagccagagccggggtgt | 5552 | GCAGAC | VEGFA | 0.385 ± 0.035 |
| 2 | tggaccccctatttctgacctc | 5553 | CCAAAC | VEGFA | 0.65 ± 0.62 |
| 3 | atgggagcccttcttcttctgc | 5554 | TCGGAC | EMX1 | -0.045 ± 0.105 |

TABLE 4b-continued

Activity of MG1-6 at various target sites.

| target ID | target sequence | Target sequence SEQ ID NO: | PAM | locus | % NHEJ (mean ± std) |
|---|---|---|---|---|---|
| 4 | tgccacgaagcaggccaatggg | 5555 | GAGGAC | EMX1 | 0.96 ± 0.14 |
| 5 | tggtgtctgtttgaggttgcta | 5556 | GTGAAC | HBB | -0.09 ± 0.09 |
| 6 | gggcaggttggtatcaaggtta | 5557 | CAAGAC | HBB | 4.915 ± 0.135 |
| 7 | aggtgctgacgtaggtagtgct | 5558 | TGAGAC | FANCF | 3.85 ± 1.86 |
| 9 | aatgtatgctggcttttaaggg | 5560 | GGAAAC | IVS40 | -0.215 ± 0.105 |
| 10 | gctcctttggctagggaagtgt | 5561 | TAAAAC | IVS40 | 3.03 ± 3.5 |

Figure 39:
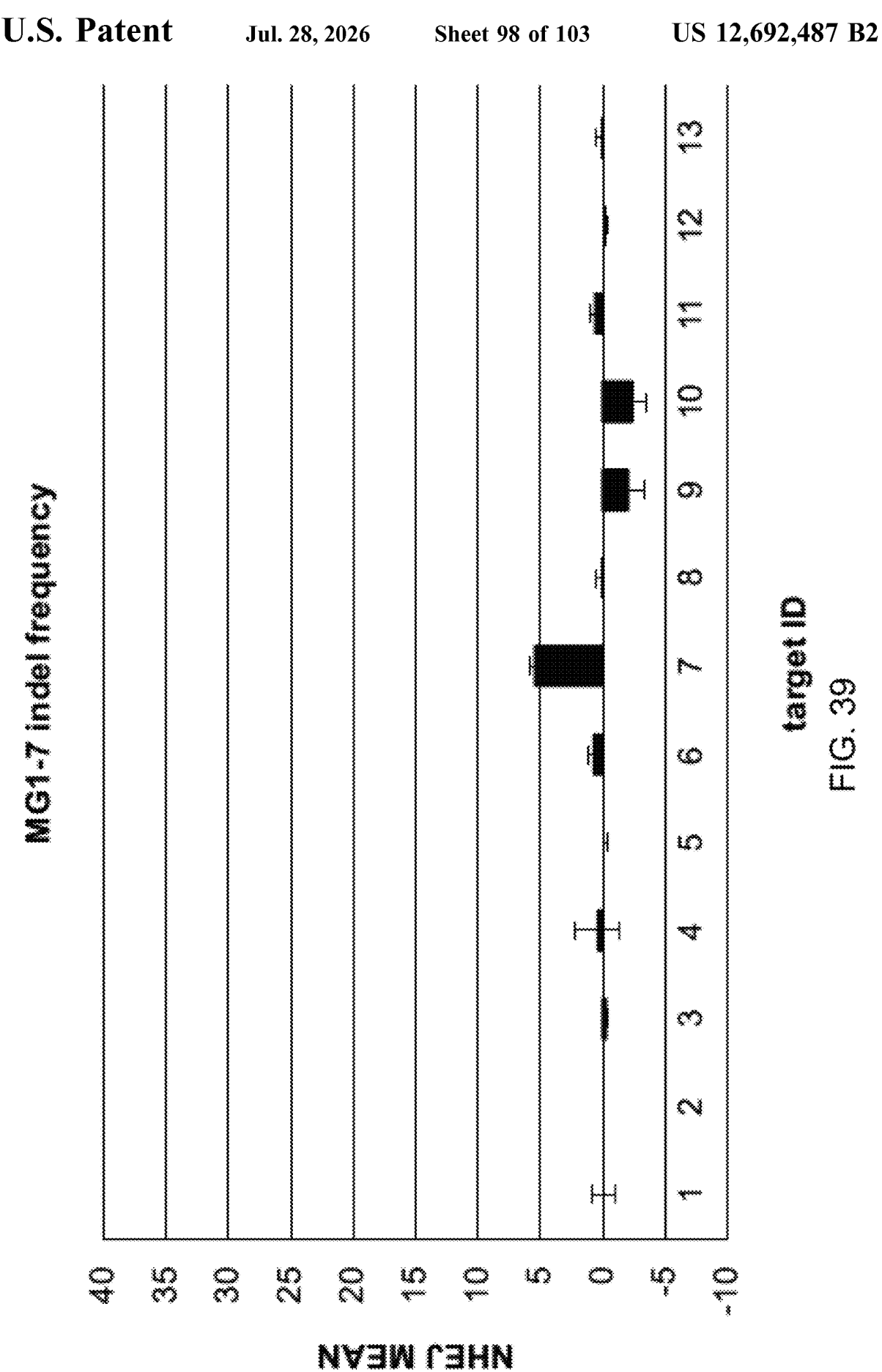

MG1-7 target loci were chosen to test locations in the genome with the PAM nRRRAAG (SEQ ID NO: 5515). The spacers corresponding to the chosen target sites were cloned into the sgRNA scaffold in the mammalian vector system backbone 2 described in Example 10b. The sites are listed in Table 4c below. The activity of MG-7 at various target sites is shown in Table 4c and FIG. 39.

TABLE 4c

Activity of MG1-7 at various target sites

| target ID | target sequence | Target sequence SEQ ID NO: | PAM | locus | % NHEJ (mean ± std) |
|---|---|---|---|---|---|
| 1 | atcaaactgtgagcatcttcag | 5721 | ggaaaag | IVS40 | 0.105 ± 0.88 |
| 2 | cagcgaatctactcagccagag | 5722 | caggaag | IVS40 | 0.075 ± 0.02 |
| 3 | ctttaacttgtgtgattctgga | 5723 | gaggaag | IVS40 | -0.25 |
| 4 | agcttaattagctcctttggct | 5724 | agggaag | IVS40 | 0.545 ± 1.71 |
| 5 | ccatggtgcatctgactcctga | 5725 | ggagaag | HBB | 0.005 ± 0.01 |
| 6 | tgcttgagaccgccagaagctc | 5726 | ggaaaag | FANCF | 0.91 ± 0.38 |
| 7 | cgagaacagcccagaagttgga | 5727 | cgaaaag | VEGFA | 5.49 ± 0.44 |
| 8 | cggaggagccgtggtccgcgcg | 5728 | ggggaag | VEGFA | 0.27 ± 0.20 |
| 9 | atgtgtgagaaaaatttaatca | 5729 | taagaag | Apolipoprotein | -1.85 ± 1.89 |
| 10 | aggtccaagtaaaatttgtctt | 5730 | agaaaag | Apolipoprotein | -2.17 ± 2.55 |
| 11 | gtacaaacggcagaagctggag | 5731 | gaggaag | EMX1 | 0.775 ± 0.33 |
| 12 | aggaagggcctgagtccgagca | 5732 | gaagaag | EMX1 | 0.01 ± 0.01 |
| 13 | aagggcctgagtccgagcagaa | 5733 | gaagaag | EMX1 | 0.185 ± 0.22 |

Example 12—Characterization of MG2 Family
Members

PAM Specificity, tracrRNA/sgRNA Validation

The targeted endonuclease activity of MG2 family members was confirmed in the myTXTL system as described in Example 6. Results of this assay are shown in FIGS. 17-20. In the assay shown in FIGS. 17-20, active proteins that successfully cleave the library result in a band around 170 bp in the gel. Amplification products were observed for MG2-1 (see gel 2 lane 11 and gel 4 lane 6) and MG2-7 (see gel 11 lane 10) (SEQ ID NOs: 320 and 321, respectively). Sequencing the PCR products revealed active PAM sequences in Table 5 below:

TABLE 5

| | | | | | | | |
|---|---|---|---|---|---|---|---|
| PAM sequence specificities and related data for MG2 enzymes | | | | | | | |
| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
| MG2-1 | 320 | nRCGTA | 5531 | 5490 | N/A | N/A | N/A |
| MG2-7 | 321 | N/A | N/A | 5491 | 5465 | NNNRTA | 5516 |

Targeted Endonuclease Activity in Bacterial Cells

In vivo activity of the MG2-7 endonuclease system with a sgRNA (endonuclease SEQ ID NO: 321; sgRNA SEQ ID NO: 5465) and an AGCGTAAG PAM sequence was confirmed using the method described in Example 9. Transformed *E. coli* were plated in serial dilution, and the results (showing *E. coli* serial dilutions in the left panel and quantitated growth in the right panel) are presented in FIG. 34. A substantial reduction in the growth of *E. coli* expressing on target sgRNA compared to *E. coli* expressing non-target sgRNA indicates that genomic DNA was specifically cleaved by the MG1-4 endonuclease in *E. coli* cells.

Example 13—Characterization of MG3 Family
Members

PAM Specificity, tracrRNA/sgRNA Validation

The targeted endonuclease activity of MG3 family members was confirmed using the myTXTL system as described in Example 6 using tracr sequences and CRISPR arrays. In this assay, PCR amplification of cleaved target plasmids yields a product that migrates at approximately 170 bp in the gel, as shown in FIGS. 17-20. Amplification products were observed for MG3-6 (dual guide: see gel 2 lane 8; single guide: see gel 3 lane 3), MG3-7 (dual guide: see gel 2 lane 3, single guide: see gel 3 lane 4), and MG3-8 (dual guide: see gel 9 lane 5) (SEQ ID NOs: 421, 422, and 423, respectively). Sequencing the PCR products revealed active PAM sequences in Table 6 below:

TABLE 6

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG3-6 | 421 | nnRGGTT | 5532 | 5500 | 5466 | nnGGG | 5517 |
| MG3-7 | 422 | nnRnYAY | 5533 | 5501 | 5467 | nnGnTnT | 5518 |
| MG3-8 | 423 | nnRGGTT | 5534 | 5502 | N/A | N/A | N/A |

Synthetic single guide RNAs (sgRNAs) were designed based on the sequences and predicted structures of the tracrRNAs and are presented as SEQ ID NOs: 5466-5467. The PAM sequence screen of Example 6 was repeated with the sgRNAs. The results of this experiment are also presented in Table 6, which reveals that PAM specificity changed slightly when using sgRNAs.

Targeted Endonuclease Activity In Vitro

In vitro activity of the MG3-6 (endonuclease SEQ ID NO: 421) was verified with the PAM sequence GTGGGTTA using the method of Example 8. The single guide sequence reported above (SEQ ID NO: 5466) was used, with varying spacer/targeting sequence lengths from 18-24 nt replacing the Ns of the sequence. The results are shown in FIG. 13, wherein the top panel shows a gel demonstrating DNA cleavage by MG3-6 in combination with different sgRNAs having different targeting sequence lengths (18-24 nt), and the bottom panel shows the same data quantified as a bar graph. The data demonstrated that targeting sequences from 18-24 nucleotides were functional with the MG3-6/sgRNA system.

Targeted Endonuclease Activity in Bacterial Cells

In vivo activity of the MG3-7 endonuclease system (protein SEQ ID NO: 422; sgRNA SEQ ID NO: 5467) was tested with the PAM sequence TGGACCTG using the method of Example 9. Transformed *E. coli* were plated in serial dilution, and the results (showing *E. coli* serial dilutions in the top panel and quantitated growth in the bottom panel) are presented in FIG. 14. A substantial reduction in the growth of *E. coli* expressing on target sgRNA compared to *E. coli* expressing non-target sgRNA indicates that genomic DNA was being specifically cleaved by the MG3-7 endonuclease system.

Targeted Endonuclease Activity in Mammalian Cells (a)

Figure 15:
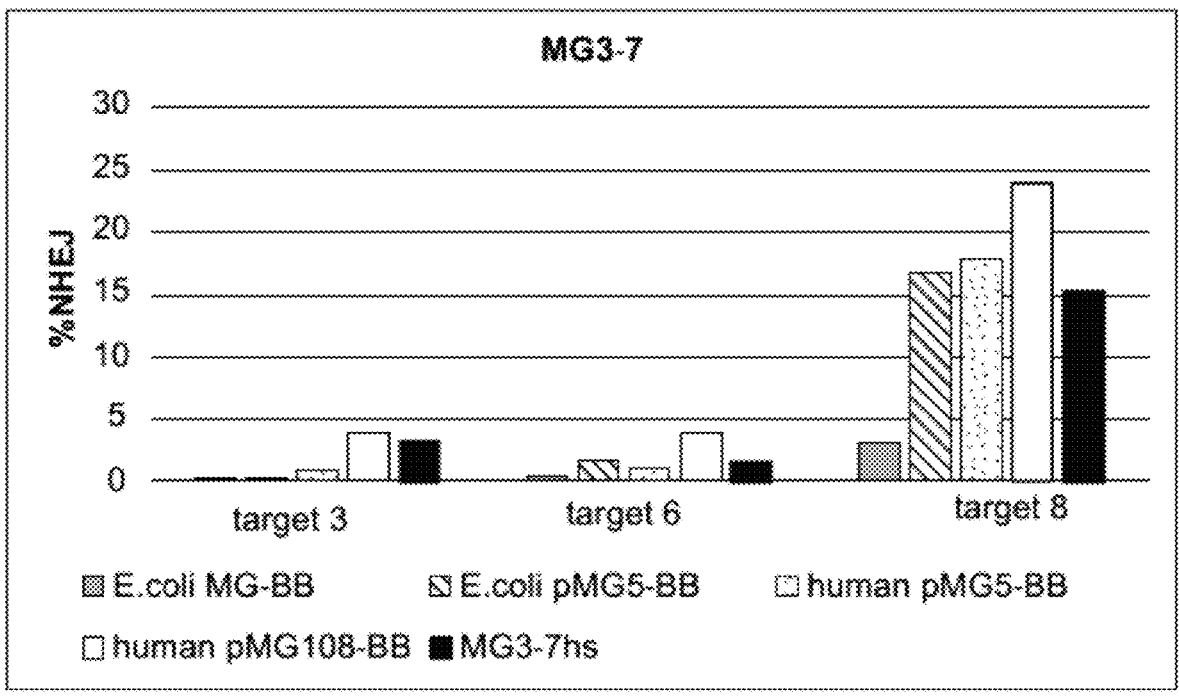
FIG. 15 depicts in cell indel formation generated by transfection of HEK cells with MG3-7 constructs described in Example 13 alongside their corresponding sgRNAs containing various different targeting sequences targeting various locations in the human genome.

The method of Example 10 was used to demonstrate targeting and cleavage activity in mammalian cells. Open reading frames encoding MG3-7 (protein SEQ ID NO: 422) was cloned into 2 mammalian expression vectors, one with a C-terminal SV40 NLS and a 2A-GFP tag (*E. coli* MG-BB) and one with no GFP tag and 2 NLS sequences, one on the N-terminus and one on the C-terminus (*E. coli* pMG5-BB). The endonuclease expression vectors were cotransfected into HEK293T cells with a second vector for expressing the sgRNA above with a guide sequence selected from Table 7. The results of this experiment are shown in FIG. 12. 72 hr after co-transfection DNA was extracted and used for the preparation of an NGS-library. Cleavage activity was detected by the appearance of internal deletions (NHEJ remnants) in the vicinity of the target site. Results are presented in FIG. 15.

The target site which were encoded on the sgRNA plasmids are shown in Table 7 below.

TABLE 7

MG3-7 mammalian targeting sequences

| MG3-7 Target ID | MG3-7 Targeting Sequence | Targeting sequence SEQ ID NO: | Targeted Gene |
|---|---|---|---|
| 1 | cccctatttctgacctcccaaa | 5562 | VEGFA |
| 2 | tgtggttccagaaccggaggac | 5563 | EMX1 |
| 3 | ggccctgggcaggttggtatca | 5564 | HBB-R01 |
| 4 | tccttaaacctgtcttgtaacc | 5565 | HBB-R01 |
| 5 | ctgactcctgaggagaagtctg | 5566 | HBB-R01 |
| 6 | tccgagcttctggcggtctcaa | 5567 | FANCF |
| 7 | tatcatttcgcggatgttccaa | 5568 | FANCF |
| 8 | tcgggcagagggtgcatcacct | 5569 | Apolipoprotein |
| 9 | ataataagcagaactttagtg | 5570 | Fibrinogen |
| 10 | gttttctttagttattaatttc | 5571 | Fibrinogen |

Targeted Endonuclease Activity in Mammalian Cells (b)

Figure 40:
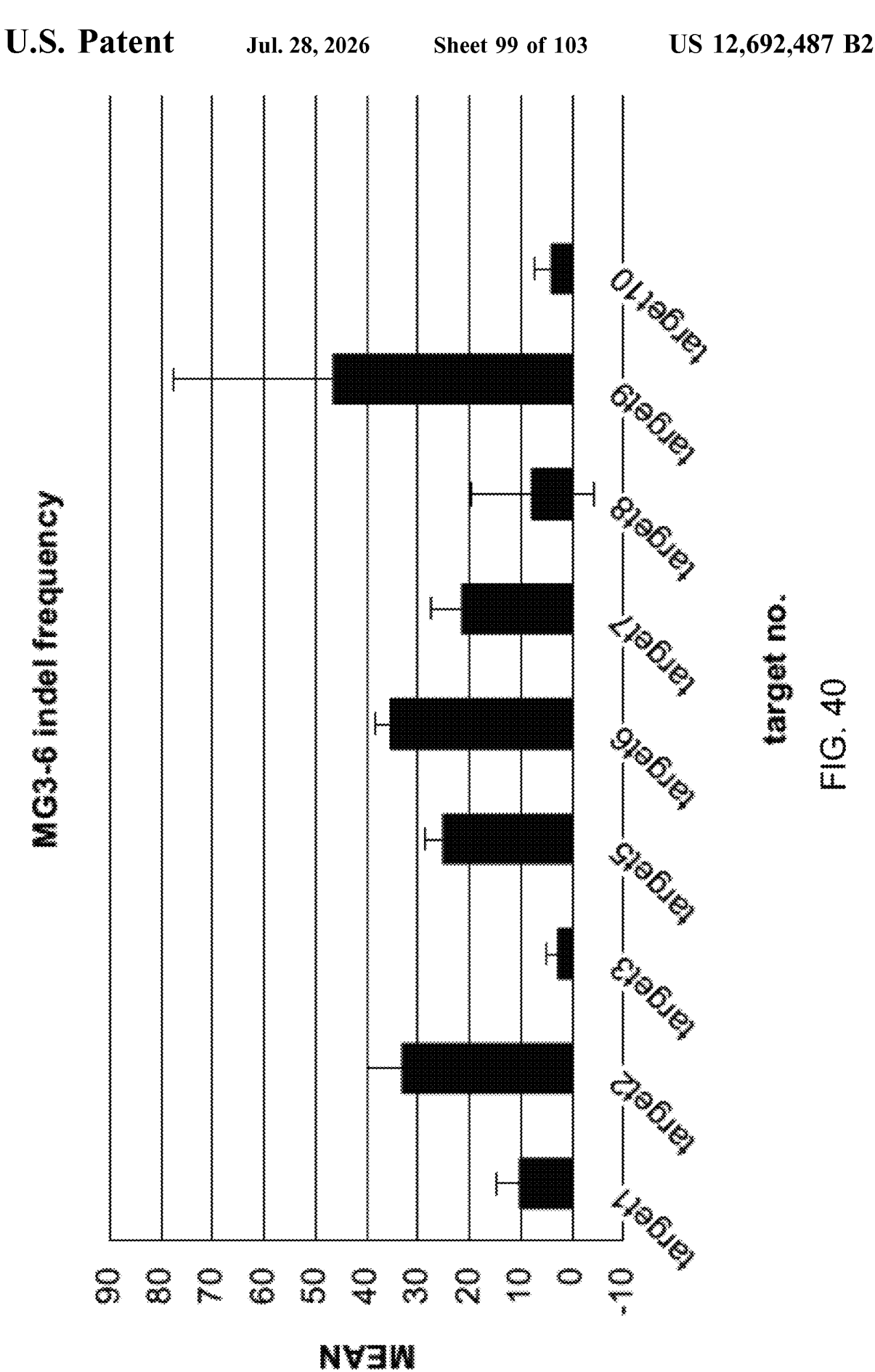
FIGS. 40-42 depicts in cell indel formation generated by transfection of HEK cells with MG3-6, MG3-7 and MG3-8 constructs described in Example 13 alongside their corresponding sgRNAs containing various different targeting sequences targeting various locations in the human genome.

MG3-6 target loci were chosen to test locations in the genome with the PAM nnRGGTT (SEQ ID NO: 5532). The spacers corresponding to the chosen target sites were cloned into the sgRNA scaffold in the mammalian vector system backbone 1 described in Example 10b. The sites are listed in Table 7a below. The activity of MG3-6 at various target sites is shown in Table 7a and FIG. 40.

TABLE 7a

Activity of MG3-6 at various target sites

| target ID | target sequence | Target sequence SEQ ID NO: | PAM | locus | % NHEJ (mean ± std) |
|---|---|---|---|---|---|
| target1 | gagtgactgaaacttcacagaa | 5734 | tagggtt | Albumin | 9.755 ± 4.67 |
| target2 | ttctatttatgagatcaacagc | 5735 | acaggtt | Albumin | 32.75 ± 7.42 |
| target3 | cagatgcaccatggtgtctgtt | 5736 | tgaggt | HBB_R01 | 2.525 ± 2.13 |
| target5 | gaggccctgggcaggttggtat | 5737 | caaggtt | HBB_R01 | 25.16 ± 3.67 |
| target6 | aggttggtatcaaggttacaag | 5738 | acaggtt | HBB_R01 | 35.27 ± 2.78 |
| target7 | tcaactttcctggcaacttgcg | 5739 | gtaggtt | Apolipoprotei | 21.57 ± 5.70 |
| target8 | aggaacattcagttaagatagt | 5740 | ctaggtt | Fibrinogen | 7.5675 ± 11.99 |
| target9 | tttaaattatgaatccatctct | 5741 | aaaggtt | Fibrinogen | 46.3175 ± 31.46 |
| target10 | gagtgactgaaacttcacagaa | 5742 | tagggtt | Albumin | 3.9325 ± 3.53 |

Figure 41:
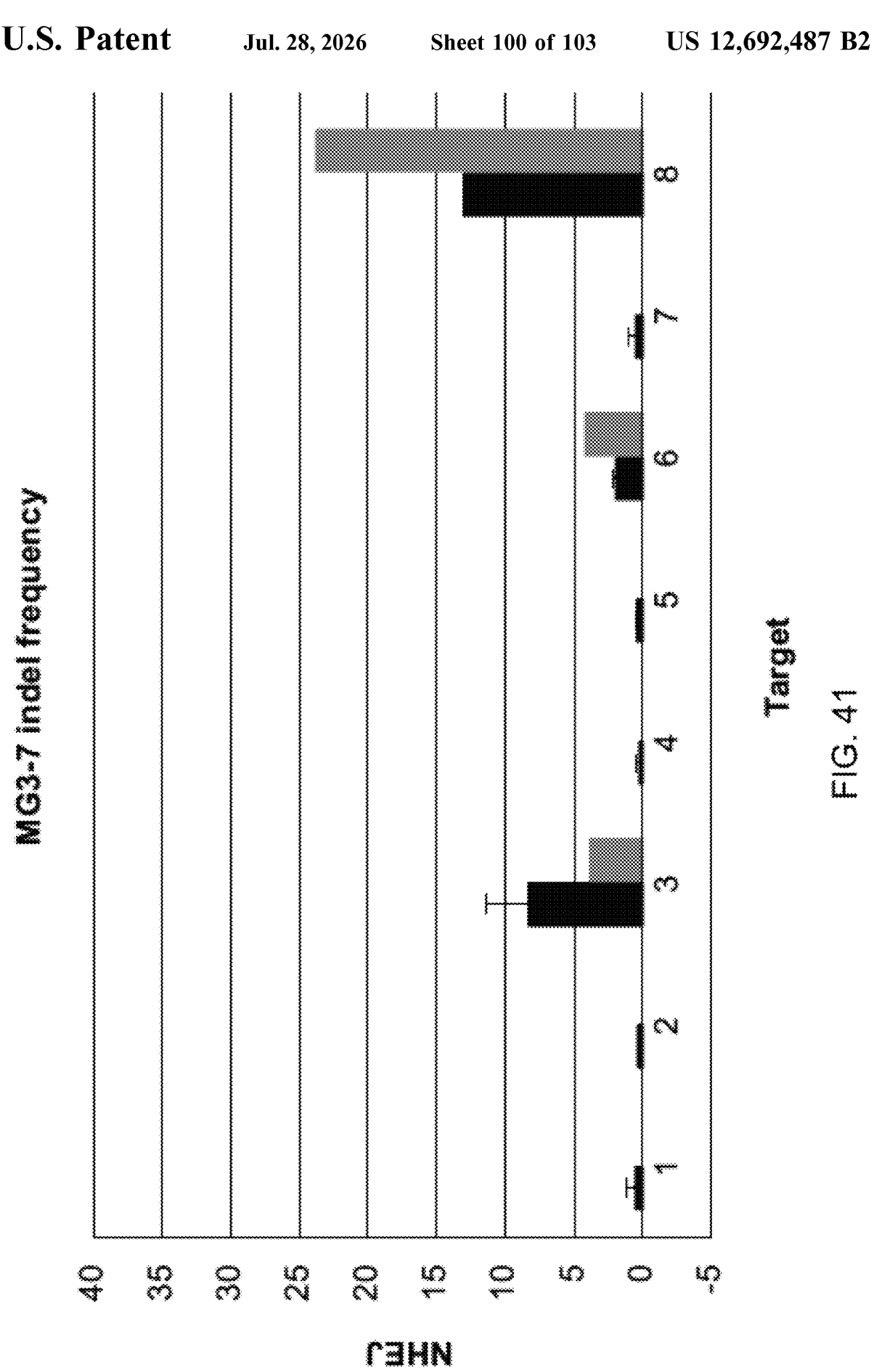

MG3-7 target loci were chosen to test locations in the genome with the PAM nnRnTAC (SEQ ID NO: 5718). The spacers corresponding to the chosen target sites were cloned into the sgRNA scaffold in the mammalian vector systems described in Example 10b. The sites are listed in Table 7b below. The activity of MG3-7 at various target sites is shown in Table 7b and FIG. 41.

TABLE 7b

Activity of MG3-7 at various target sites

| target ID | target sequence | Target sequence SEQ ID NO: | PAM | locus | % NHEJ backbone 2 (mean ± std) | % NHEJ backbone 1 |
|---|---|---|---|---|---|---|
| 1 | cccctatttctgacctcccaaa | 5562 | CAGCTAC | VEGFA | 0.54 ± 0.44 | |
| 2 | tgtggttccagaaccggaggac | 5563 | AAAGTAC | EMX1 | -0.09 ± 0.04 | |
| 3 | ggccctgggcaggttggtatca | 5564 | AGGTTAC | HBB | 8.275 ± 0.3.12 | 3.87 |
| 4 | tccttaaacctgtcttgtaacc | 5565 | TTGATAC | HBB | 0.16 ± 0.20 | |
| 5 | ctgactcctgaggagaagtctg | 5566 | CCGTTAC | HBB | 0.245 ± 0.16 | |
| 6 | tccgagcttctggcggtctcaa | 5567 | GCACTAC | FANCF | 1.84 ± 0.10 | 3.95 |
| 7 | tatcatttcgcggatgttccaa | 5568 | TCAGTAC | FANCF | 0.325 ± 0.68 | |
| 8 | tcgggcagagggtgcatcacct | 5569 | GGACTAC | Apolipoprotein | 13 | 23.88 |

Figure 42:
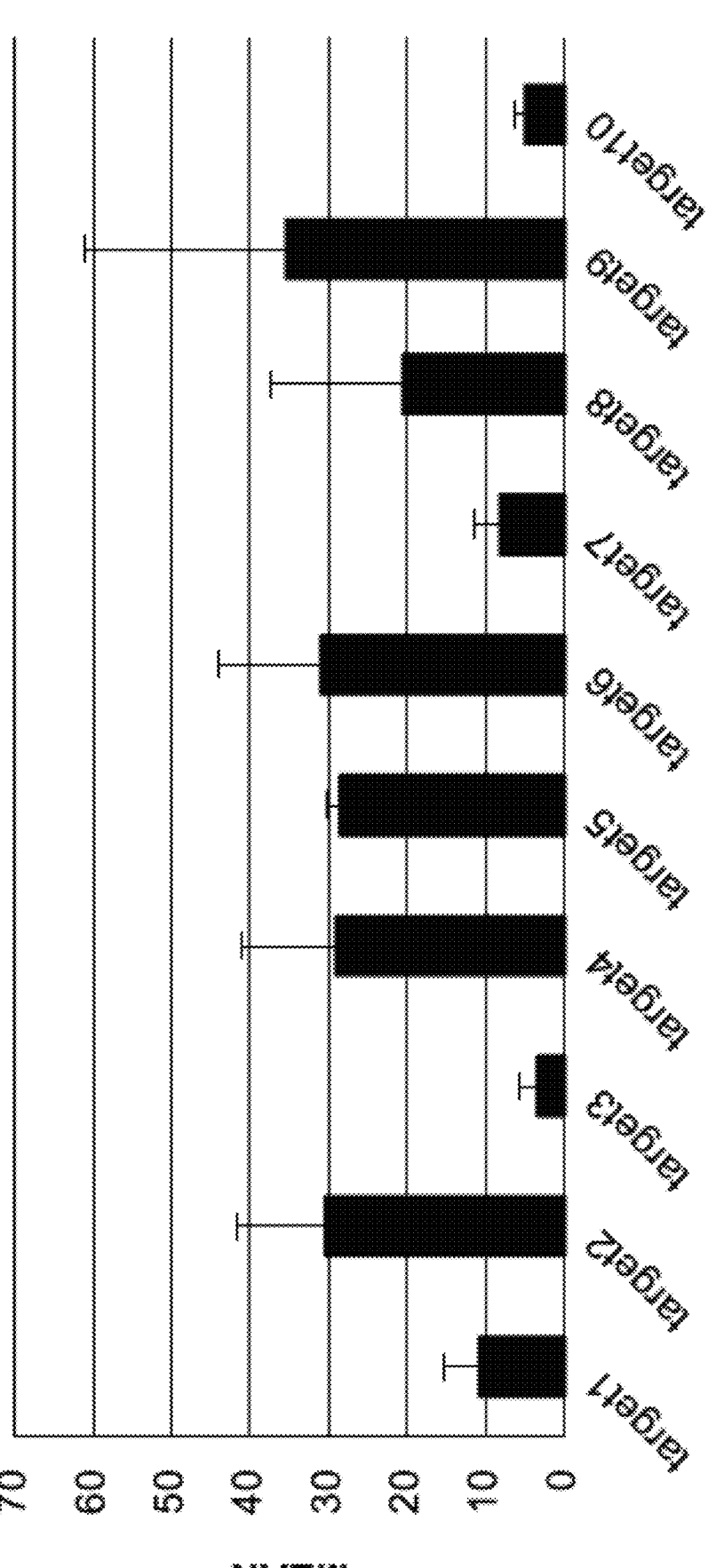

MG3-8 target loci were chosen to test locations in the genome with the PAM nnRGGTT (SEQ ID NO: 5534). The spacers corresponding to the chosen target sites were cloned into the sgRNA scaffold in the mammalian vector system backbone 1 described in Example 10b. The sites are listed in Table 7c below. The activity of MG3-8 at various target sites is shown in Table 7c and FIG. 42.

TABLE 7c

Activity of MG3-8 at various target sites

| target ID | target sequence | Target sequence SEQ ID NO: | PAM | locus | % NHEJ (mean ± std) |
|---|---|---|---|---|---|
| target1 | gagtgactgaaacttcacagaa | 5743 | tagggtt | Albumin | 10.81 ± 4.26 |
| target2 | ttctatttatgagatcaacagc | 5744 | acaggtt | Albumin | 30.48 ± 11.17 |
| target3 | cagatgcaccatggtgtctgtt | 5745 | tgaggt | HBB | 3.3925 ± 2.13 |
| target4 | gaagttggtggtgaggccctgg | 5746 | gcaggtt | HBB | 28.995 ± 11.87 |
| target5 | gaggccctgggcaggttggtat | 5747 | caaggtt | HBB | 28.69 ± 1.96 |
| target6 | aggttggtatcaaggttacaag | 5748 | acaggtt | HBB | 30.8575 ± 13.24 |
| target7 | tcaactttcctggcaacttgcg | 5749 | gtaggtt | Apolipoprotein | 7.9825 ± 3.23 |
| target8 | aggaacattcagttaagatagt | 5750 | ctaggtt | Fibrinogen | 20.2925 ± 17.10 |
| target9 | tttaaattatgaatccatctct | 5751 | aaaggtt | Fibrinogen | 35.533 ± 25.46 |
| target10 | gagtgactgaaacttcacagaa | 5752 | tagggtt | Albumin | 4.9 ± 0.71 |

Example 13—Characterization of MG4 Family Members

PAM Specificity, tracrRNA/sgRNA Validation

The targeted endonuclease activity of MG4 family endonuclease systems was confirmed using the myTXTL system as described in Example 6. In this assay, PCR amplification of cleaved target plasmids yields a product that migrates at approximately 170 bp in the gel, as shown in FIGS. 17-20. Amplification products were observed for, MG4-2 (dual guide: see gel2 lane 9, single guide: see gel 10 lane 7) (SEQ ID NO: 432). Sequencing the PCR products revealed active PAM sequences shown in Table 8 below.

TABLE 8

PAM sequence specificities and related data for MG4 enzymes

| Enzyme | Enzyme protein SEQ ID NO | tracrRNA SEQ ID NO: | sgRNA SEQ ID NO: | Synthetic (single guide) PAM | Synthetic (single guide) PAM SEQ ID NO: |
|---|---|---|---|---|---|
| MG4-5 | 432 | 5503 | 5468 | nnCCR | 5519 |

Example 14—Characterization of MG14 Family
Members

PAM Specificity, tracrRNA/sgRNA Validation

The targeted endonuclease activity of MG14 family members (was confirmed using the myTXTL system as described in Example 6. In this assay, PCR amplification of cleaved target plasmids yields a product that migrates at approximately 170 bp in the gel, as shown in FIGS. 17-20. Amplification products were observed for MG14-1 (dual guide: see gel 1 lane 4, single guide: see gel 3 lane 8) (SEQ ID NO: 678). Sequencing the PCR products revealed active PAM sequence specificities shown in Table 9 below.

TABLE 9

| | | Native (dual guide) | | | | Synthetic (single guide) | Synthetic (single guide) |
|---|---|---|---|---|---|---|---|
| Enzyme | Enzyme protein SEQ ID NO | PAM determined | PAM SEQ ID NO: | tracrRNA SEQ ID NO: | sgRNA SEQ ID NO: | PAM determined | PAM SEQ ID NO: |
| MG14-1 | 678 | NNNNGGTA | 5535 | 5505 | 5469 | NNNGGRTA | 5520 |

Targeted Endonuclease Activity in Bacterial Cells

In vivo activity of the MG14-1 endonuclease system with a sgRNA (endonuclease SEQ ID NO: 678; sgRNA SEQ ID NO: 5469) and a GGCGGGGA PAM sequence was confirmed using the method described in Example 9. Transformed *E. coli* were plated in serial dilution, and the results (showing *E. coli* serial dilutions in the left panel and quantitated growth in the right panel) are presented in FIG. 35. A substantial reduction in the growth of *E. coli* expressing on target sgRNA compared to *E. coli* expressing non-target sgRNA indicates that genomic DNA was specifically cleaved by the MG1-4 endonuclease in *E. coli* cells.

Targeted Endonuclease Activity in Mammalian Cells

Figure 43:
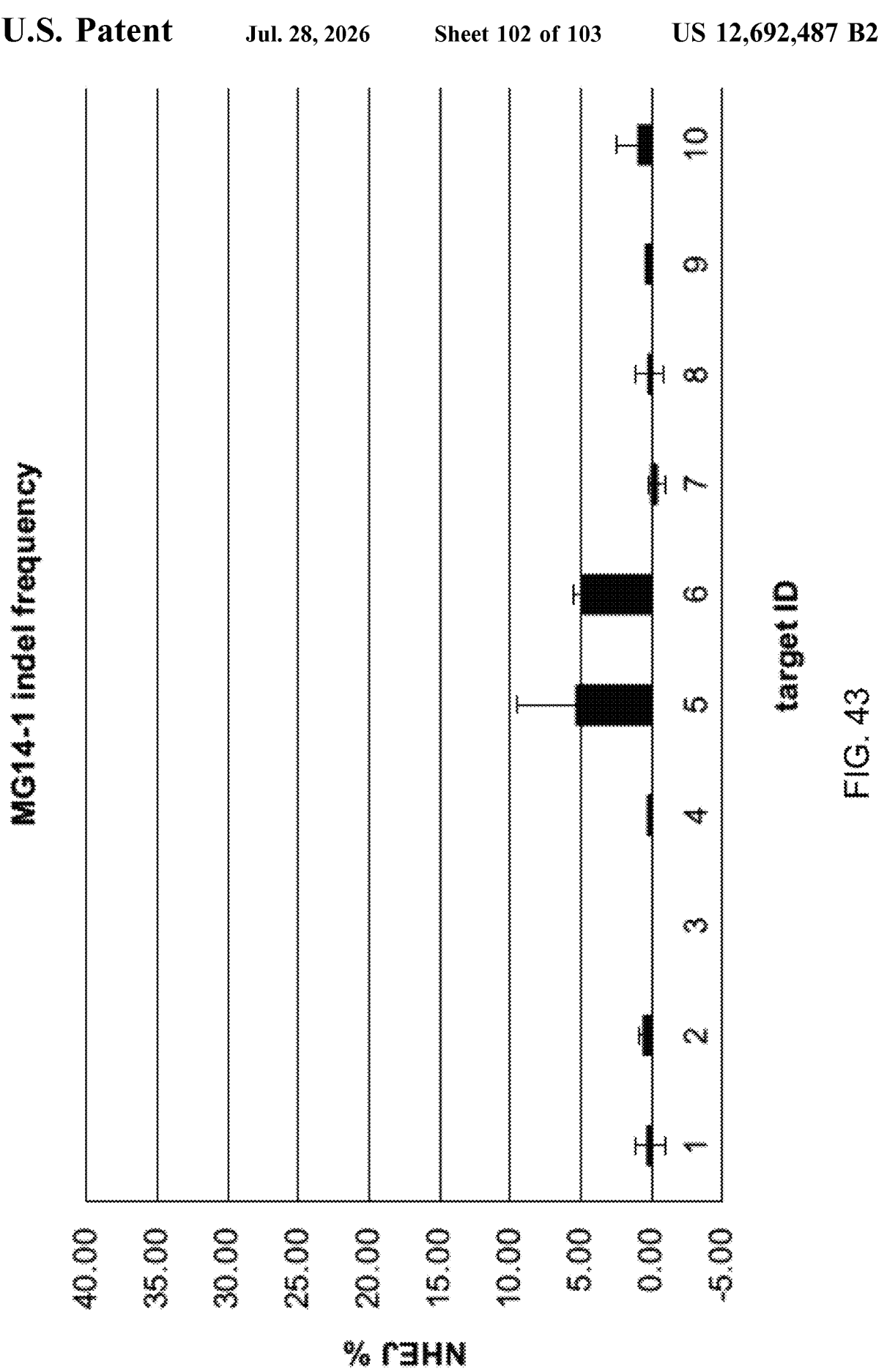
FIG. 43 depicts in cell indel formation generated by transfection of HEK cells with MG14-1 constructs described in Example 14 alongside their corresponding sgRNAs containing various different targeting sequences targeting various locations in the human genome.

MG14-1 target loci were chosen to test locations in the genome with the PAM nnnnGGTA (SEQ ID NO: 5535). The spacers corresponding to the chosen target sites were cloned into the sgRNA scaffold in the mammalian vector system backbone 2 described in Example 10b. The sites are listed in Table 9a below. The activity of MG14-1 at various target sites is shown in Table 9a and FIG. 43.

TABLE 9a

Activity of MG14-1 at various target sites

| target ID | target sequence | Target sequence SEQ ID NO: | PAM | locus | % NHEJ (mean ± std) |
|---|---|---|---|---|---|
| 1 | cttattaataaaattcaaacat | 5753 | CCTAGGTA | Albumin | 0.22 ± 1.04 |
| 2 | gttggtggtgaggccctgggca | 5754 | GGTTGGTA | HBB | 0.67 ± 0.16 |
| 3 | ctagttaatggaataaaacatt | 5755 | TTATGGTA | Fibrinogen | 0.15 |
| 4 | gcattataatgcaccaaggctt | 5756 | TATAGGTA | Fibrinogen | 0.2 |
| 5 | gtggcggggtcccaggtgctga | 5757 | CGTAGGTA | FANCF | 5.33 ± 4.13 |
| 6 | tgtccgccgccggccggggagg | 5758 | AGGTGGTA | VEGFA | 4.88 ± 0.65 |
| 7 | ggtgatgcaccctctgcccgat | 5759 | GCTTGGTA | Apolipoprotein | −0.35 ± 0.59 |
| 8 | ccacatcaactttcctggcaac | 5760 | TTGCGGTA | Apolipoprotein | 0.195 ± 0.98 |
| 9 | gctagttaatggaataaaacatt | 5761 | TTATGGTA | Fibrinogen | 0.6 |
| 10 | gcattataatgcaccaaggctt | 5762 | TATAGGTA | Fibrinogen | 1.17 ± 1.42 |

Example 15—Characterization of MG15 Family Members

PAM Specificity, tracrRNA/sgRNA Validation

The targeted endonuclease activity of MG15 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG15-1 (dual guide: see gel 7 lane 7, single guide: see gel 3 lane 9) (SEQ ID NO: 930). Sequencing the PCR products revealed active PAM sequence specificities detailed in Table 10 below.

TABLE 10

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG15-1 | 930 | nnnnC | 5536 | 5506 | 5470 | nnnnC | 5521 |

In Vitro Activity

Figure 16:
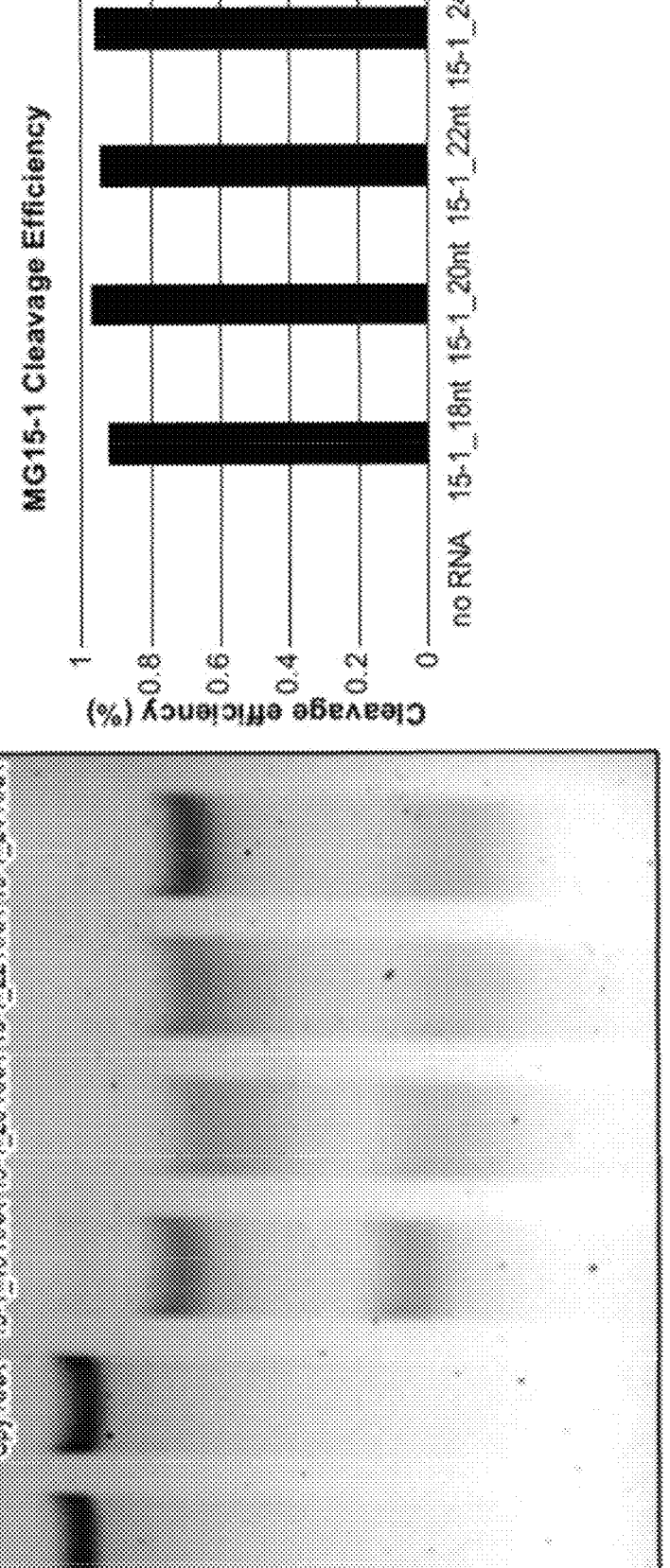
FIG. 16 depicts in vitro cleavage of DNA by MG15-1 in complex with its corresponding sgRNA containing targeting sequences of varying lengths.
Figure 17:
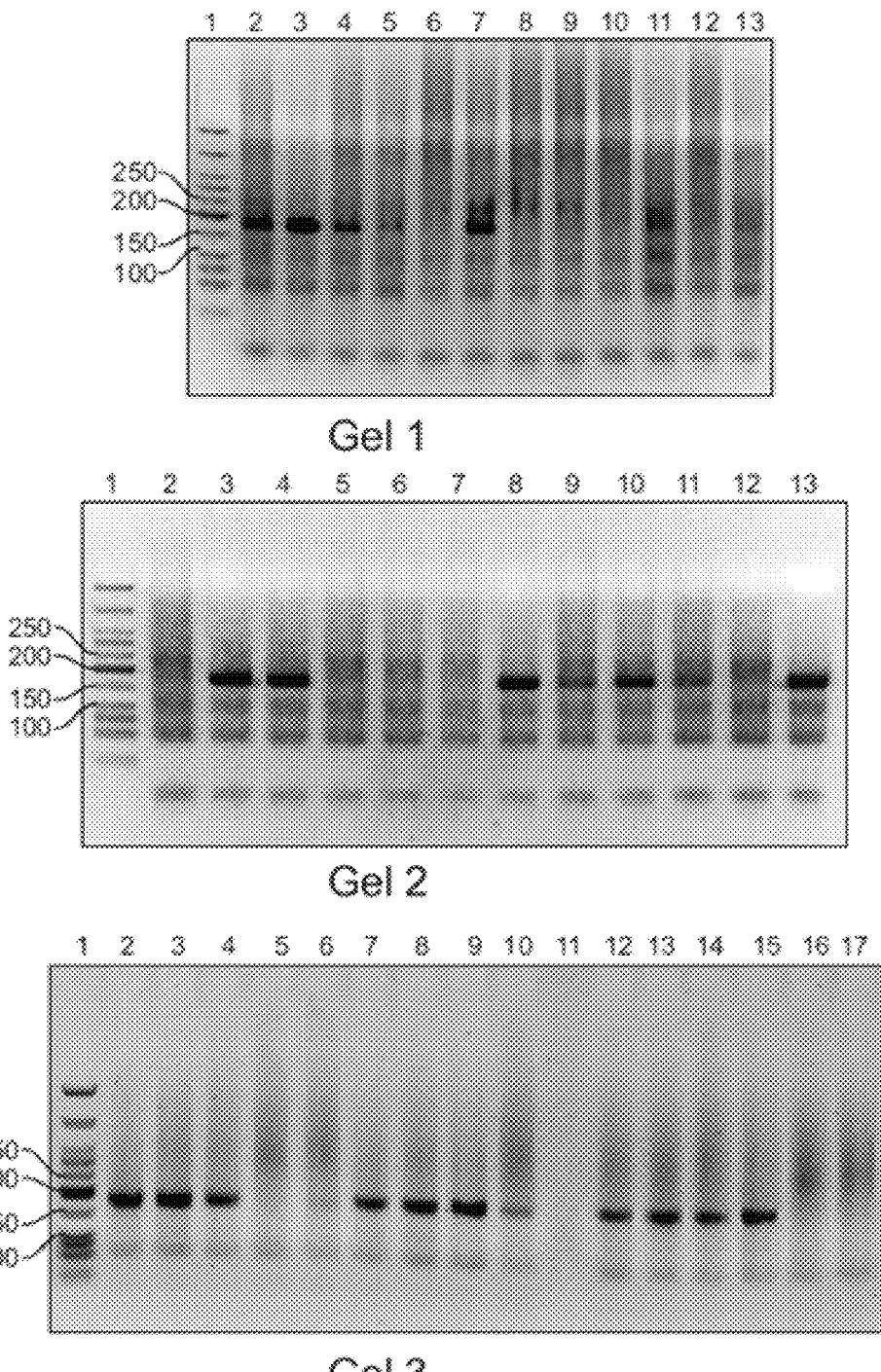
Figure 18:
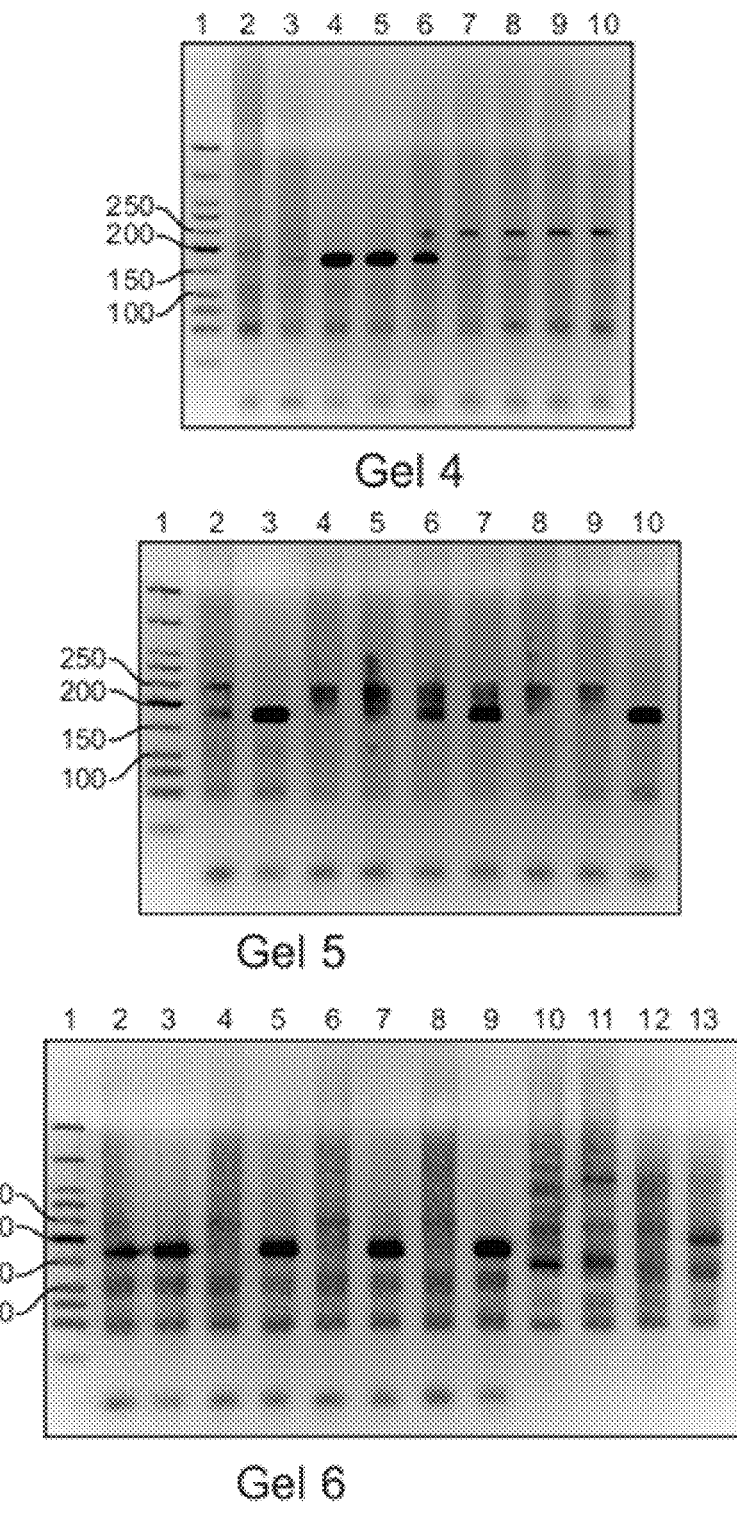
Figure 19:
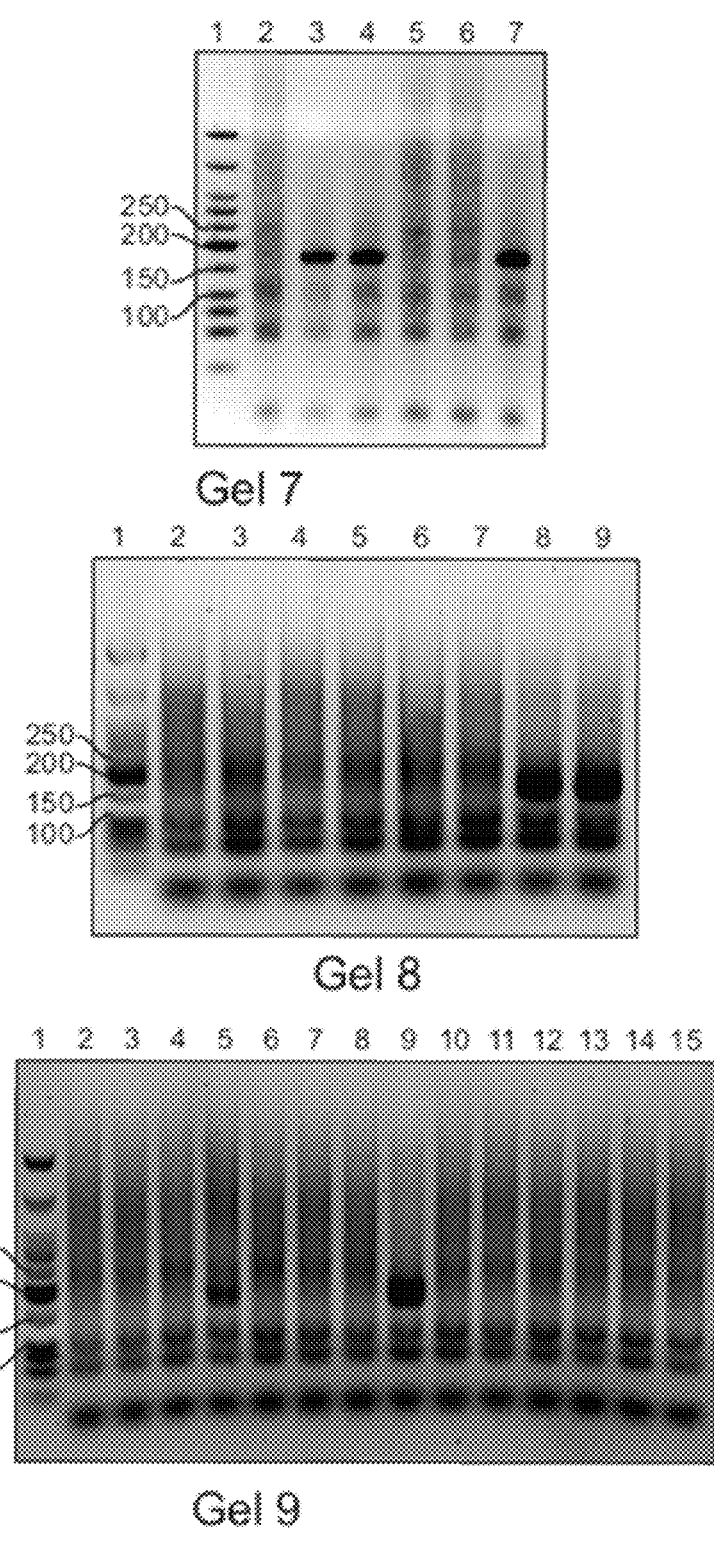
Figure 21:
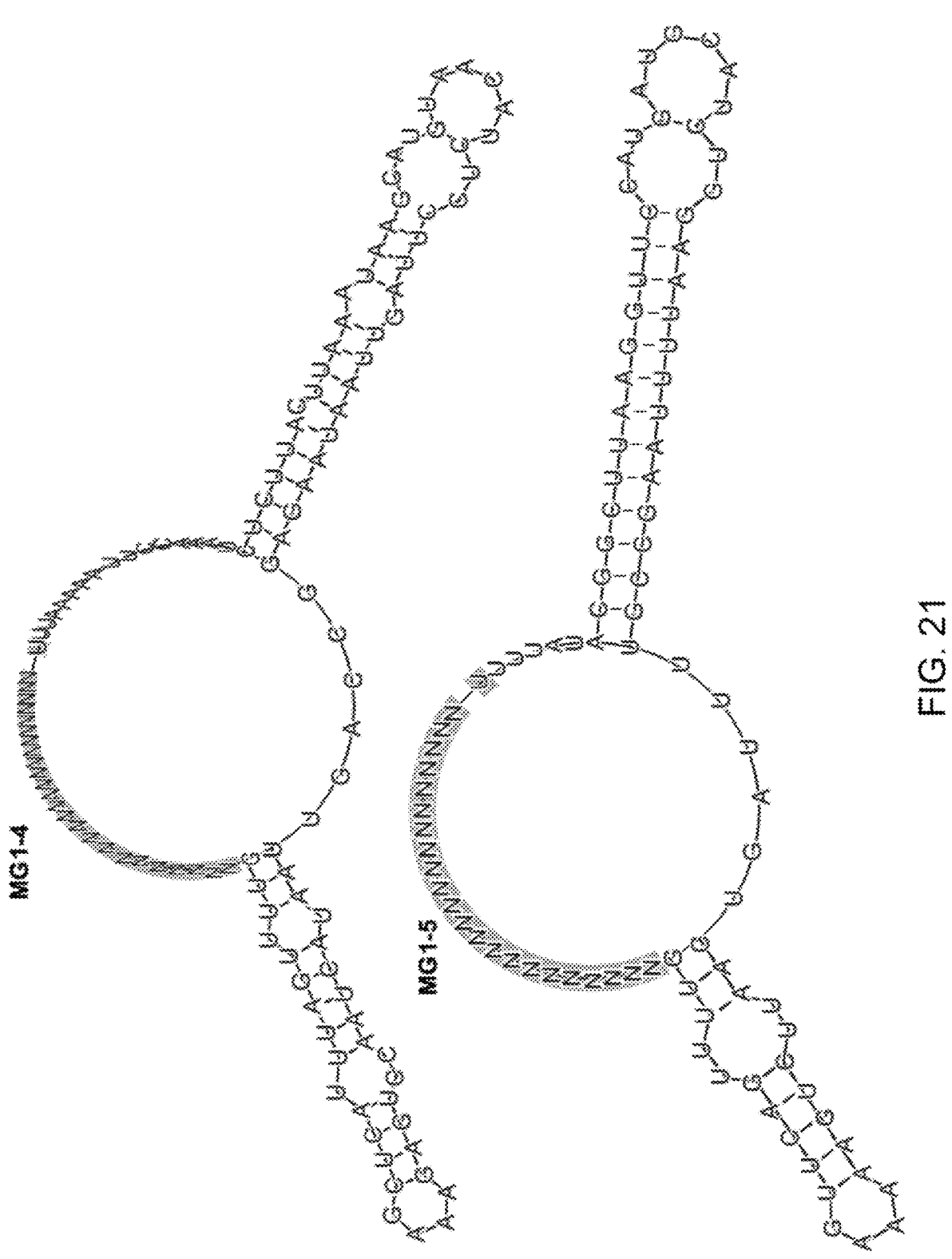
FIGS. 21, 22, 23, 24, 25 and 26 depict predicted structures (predicted e.g., as in Example 7) of corresponding sgRNAs of MG enzymes described herein.
Figure 21:
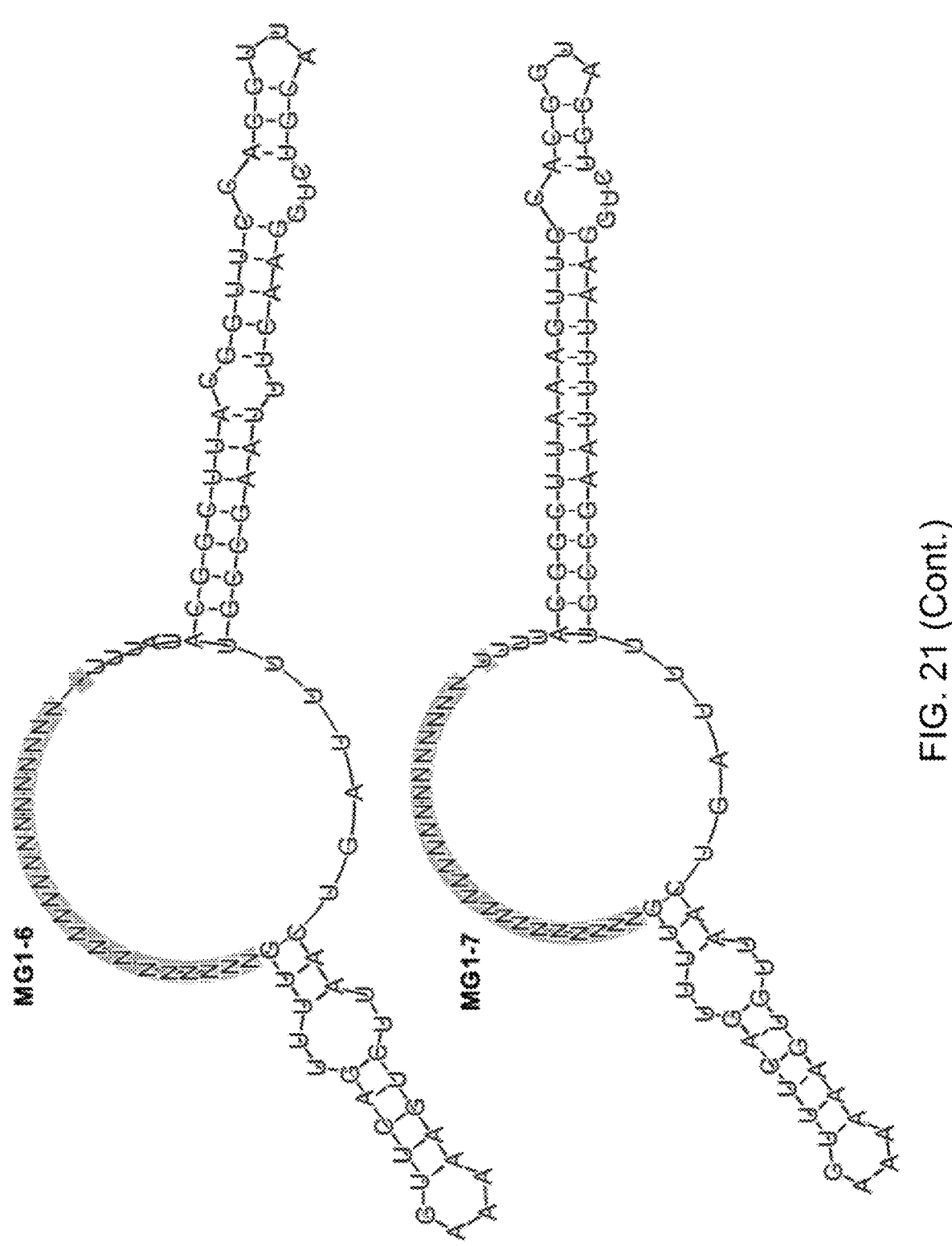
Figure 22:
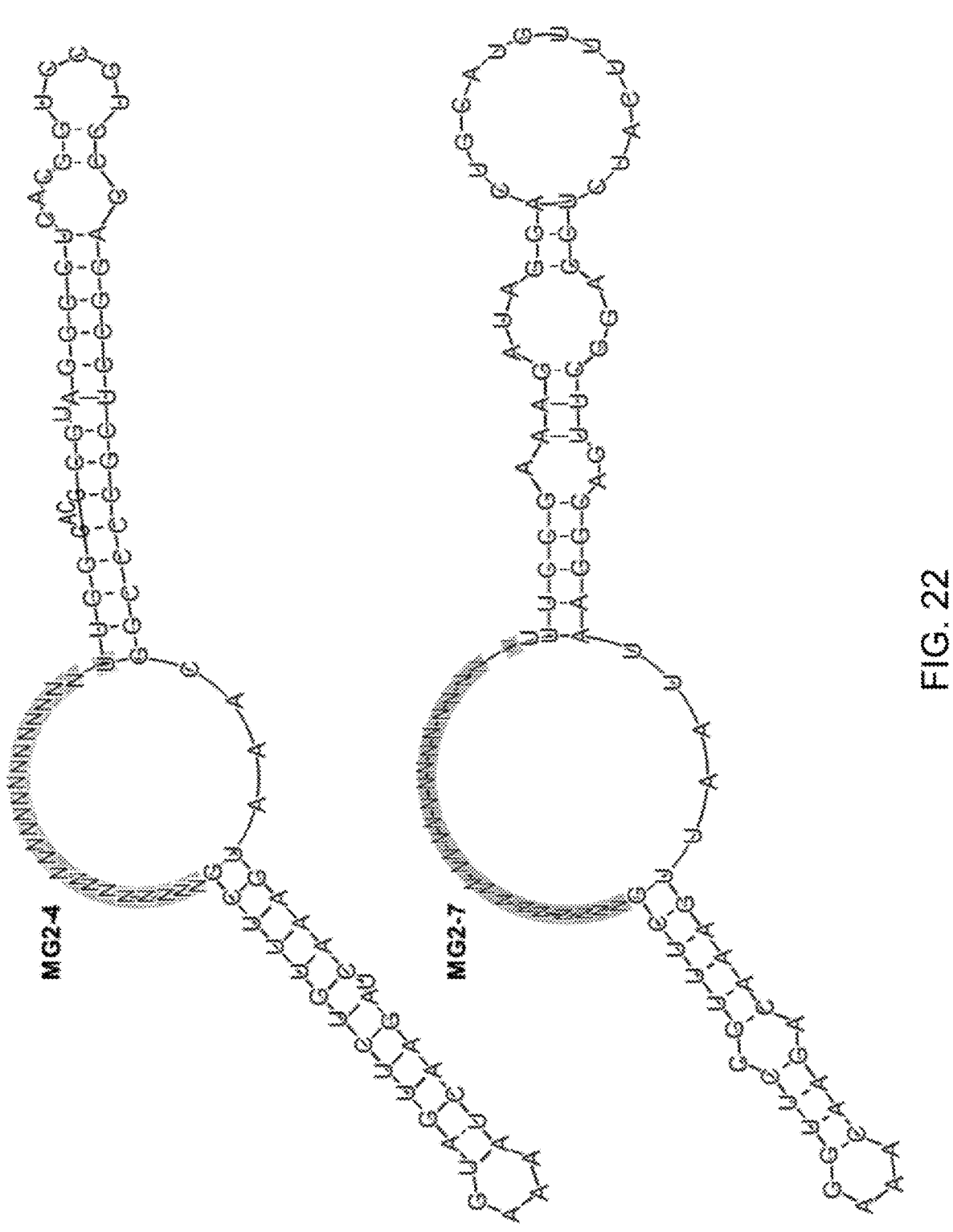
Figure 23:
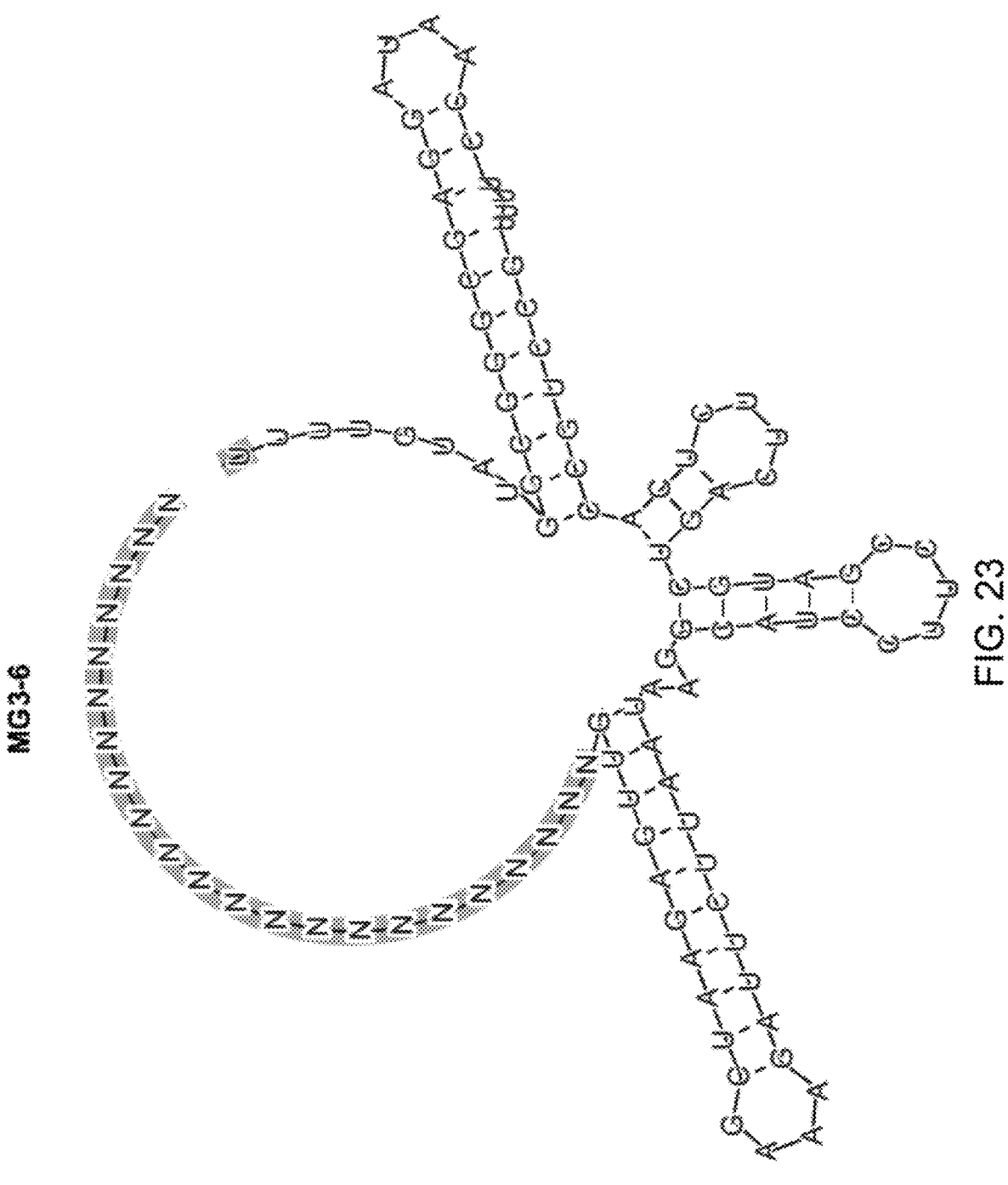
Figure 23:
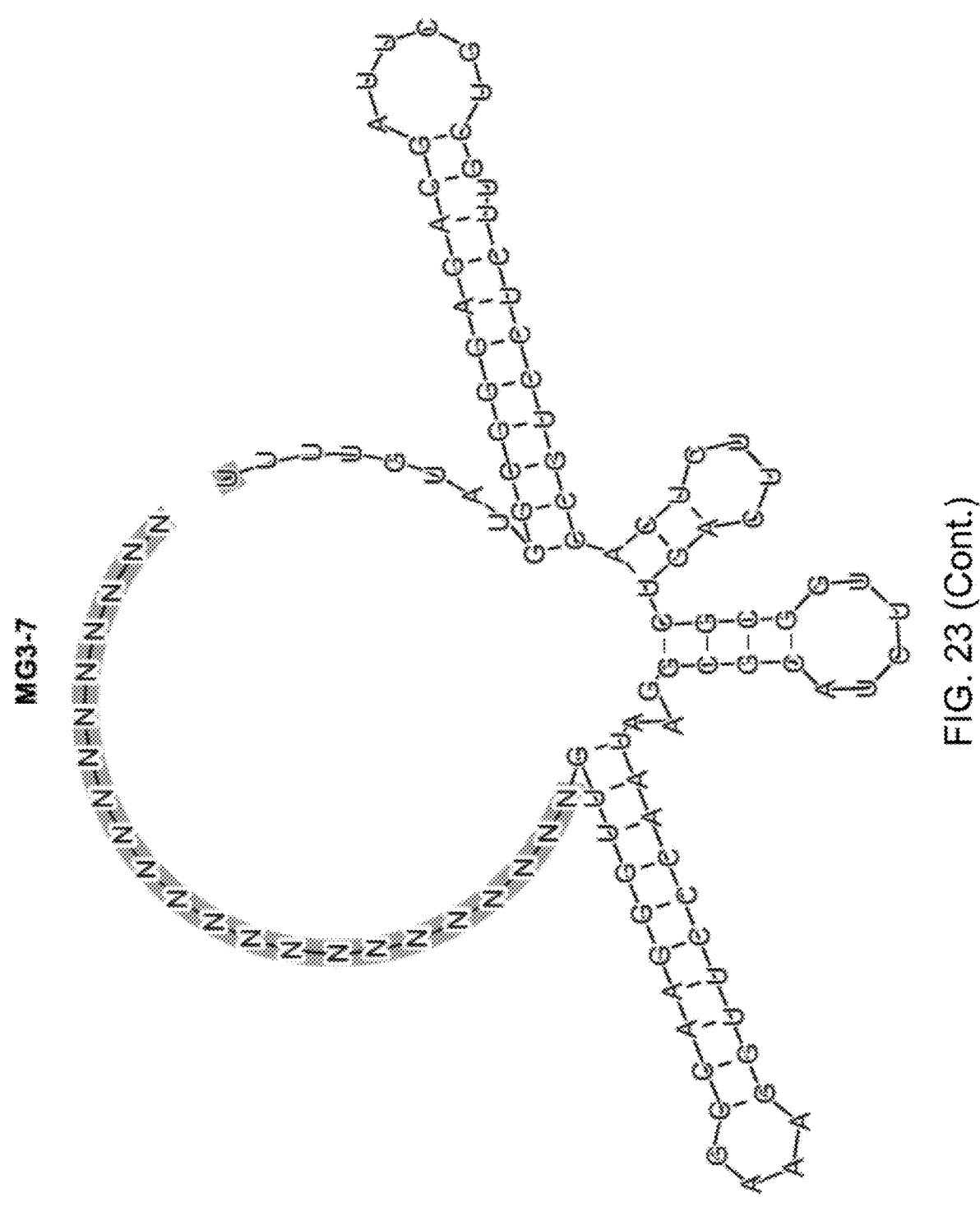
Figure 24:
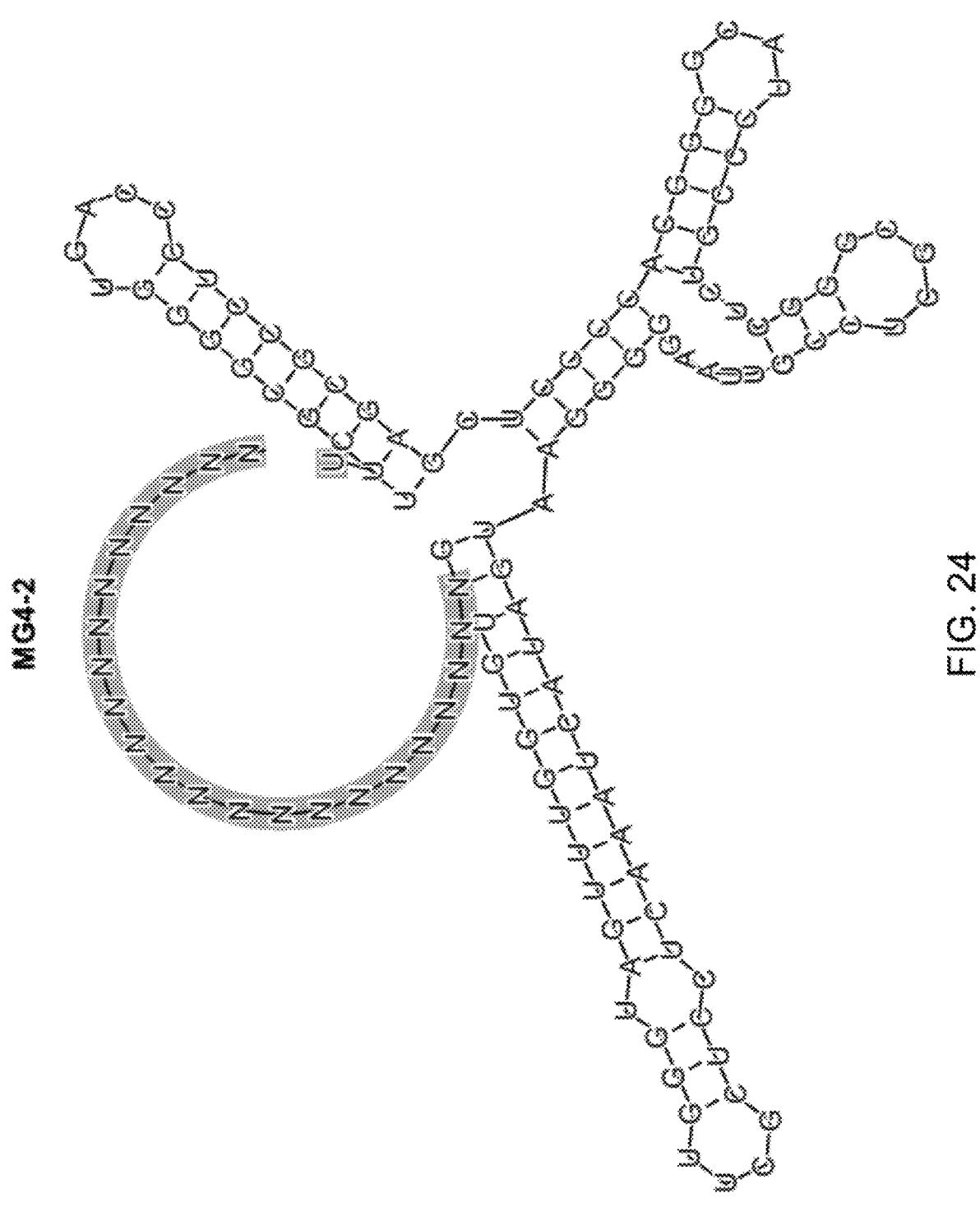
Figure 24:
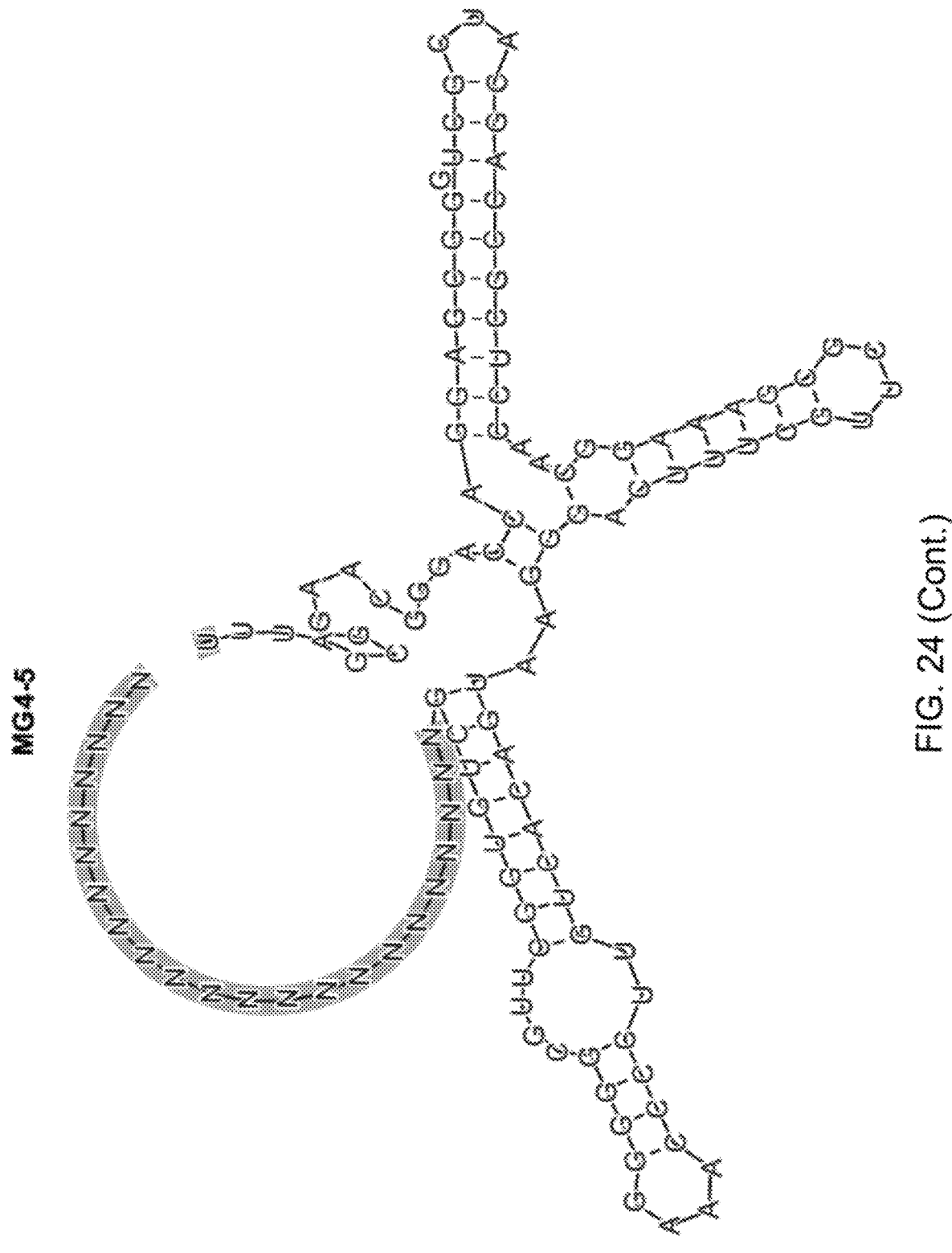
Figure 25:
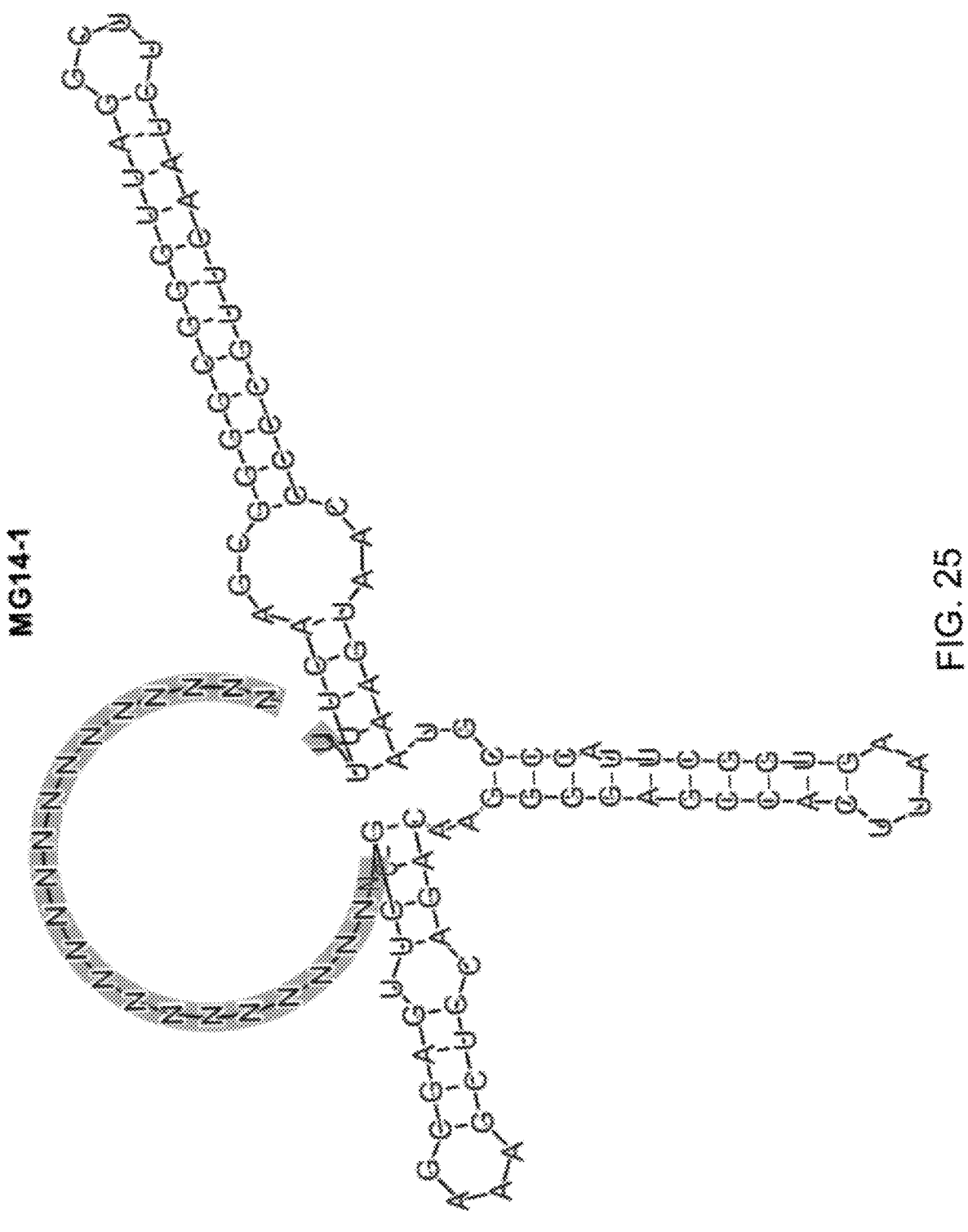
Figure 26:
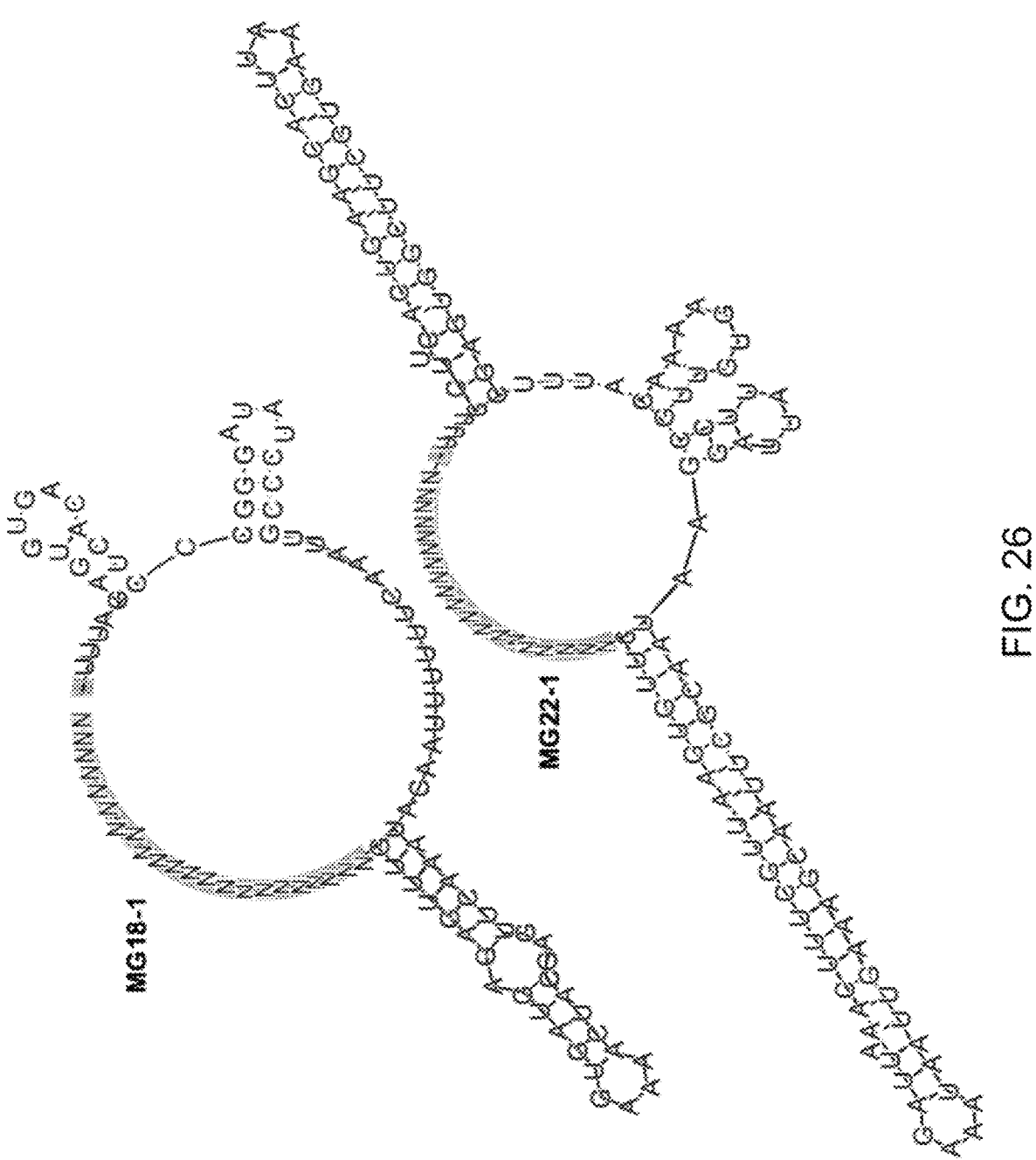
Figure 26:
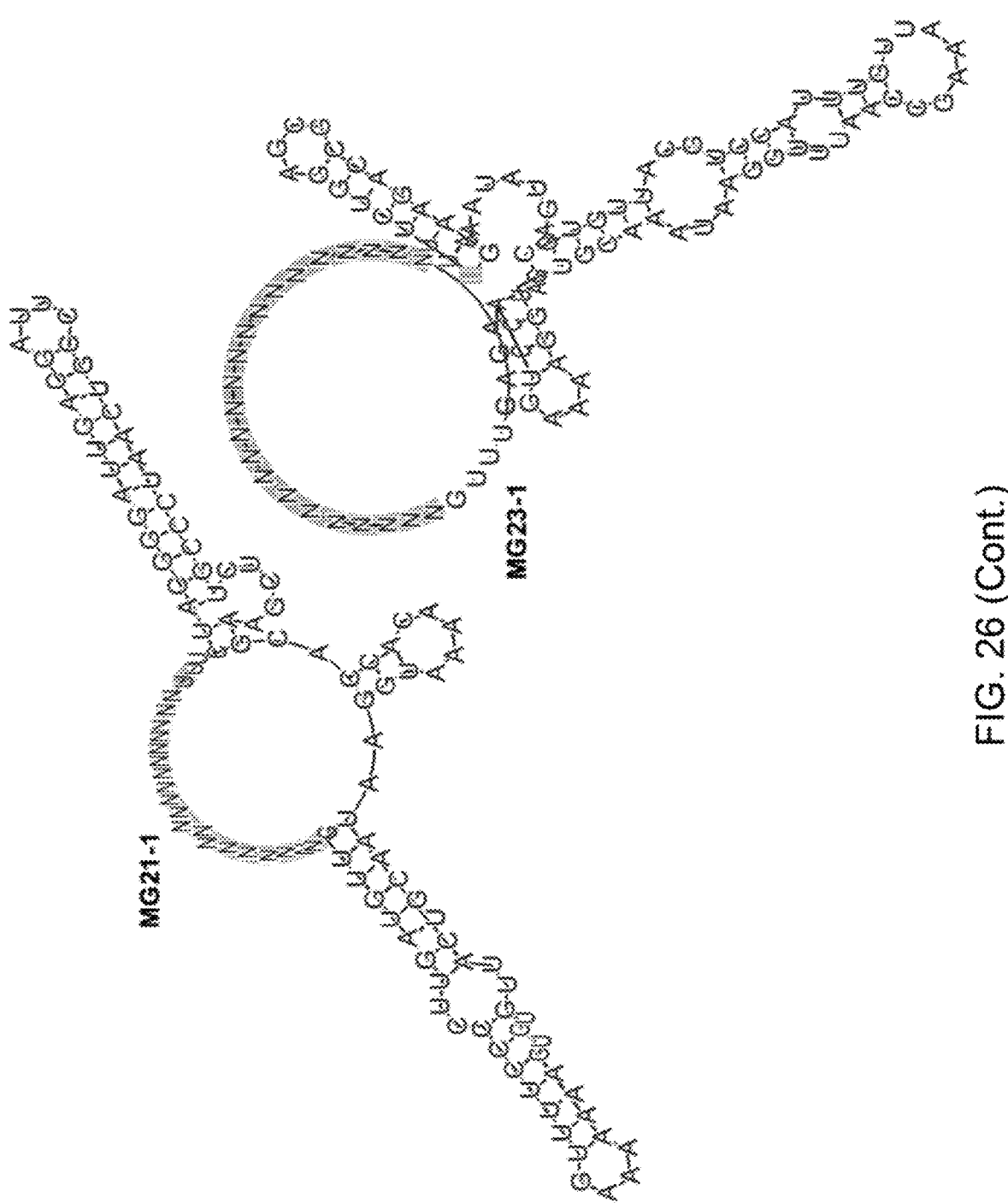
Figure 33:
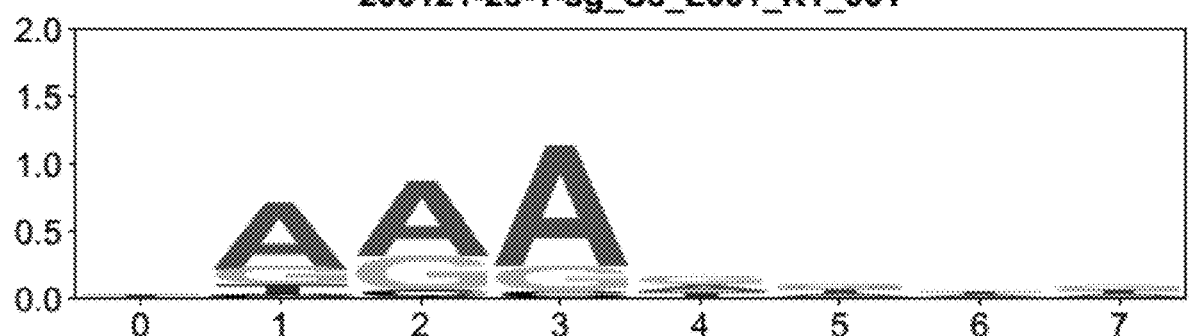

In vitro activity of the MG15-1 endonuclease system (protein SEQ ID NO: 930; sgRNA SEQ ID NO: 5470) was tested with the PAM sequence GGGTCAAA using the method of Example 8. The single guide sequence reported above (SEQ ID NO: 5470) was used, with varying spacer/targeting sequence lengths from 18-24 nt (replacing the Ns of the sequence). The results are shown in FIG. 16, wherein the top panel shows a gel demonstrating DNA cleavage by MG15-1 in combination with different sgRNAs having different targeting sequence lengths (18-24 nt), and the bottom panel shows the same data quantified as a bar graph. The data demonstrated that targeting sequences from 18-24 nucleotides were functional with the MG15-1/sgRNA system.

Targeted Endonuclease Activity in Bacterial Cells

In vivo activity of the MG15-1 endonuclease system with a sgRNA (endonuclease SEQ ID NO: 930; sgRNA SEQ ID NO: 5470) and a GGGTCAAA PAM sequence was confirmed using the method described in Example 9. Transformed *E. coli* were plated in serial dilution, and the results (showing *E. coli* serial dilutions in the left panel and quantitated growth in the right panel) are presented in FIG. 35. A substantial reduction in the growth of *E. coli* expressing on target sgRNA compared to *E. coli* expressing non-target sgRNA indicates that genomic DNA was specifically cleaved by the MG1-4 endonuclease in *E. coli* cells.

Example 16—Characterization of MG16 Family Members

PAM Specificity, tracrRNA/sgRNA Validation

The targeted endonuclease activity of MG16 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG16-2 (see gel 11, lane 17) (SEQ ID NO: 1093). Sequencing the PCR products revealed active PAM sequence specificities detailed in Table 11 below.

TABLE 11

PAM sequence specificities and related data for MG16 enzymes

| Enzyme | Enzyme protein SEQ ID NO | sgRNA SEQ ID NO: | Synthetic (single guide) PAM | Synthetic (single guide) PAM SEQ ID NO: |
|---|---|---|---|---|
| MG16-2 | 1093 | 5471 | nRTnCC | 5522 |

Example 17—Characterization of MG18 Family Members

PAM Specificity, tracrRNA/sgRNA Validation

The targeted endonuclease activity of MG18 family members was confirmed using the myTXTL system as described in Example 6. In this assay, PCR amplification of cleaved target plasmids yields a product that migrates at approximately 170 bp in the gel, as shown in FIGS. 17-20. Amplification products were observed for MG18-1 (dual guide: see gel 9 lane 9, single guide: see gel 11 lane 12) (SEQ ID NO: 1354). Sequencing the PCR products revealed active PAM sequence specificities detailed in Table 12 below.

TABLE 12

PAM sequence specificities and related data for MG18 enzymes

| Enzyme | Enzyme protein SEQ ID NO | Native (dual guide) PAM | PAM SEQ ID NO: | tracrRNA SEQ ID NO: | sgRNA SEQ ID NO: | Synthetic (single guide) PAM | Synthetic (single guide) PAM SEQ ID NO: |
|---|---|---|---|---|---|---|---|
| MG18-1 | 1354 | nRWART | 5537 | 5508 | 5472 | nnnRRT | 5523 |

Targeted Endonuclease Activity in Mammalian Cells

Figure 44:
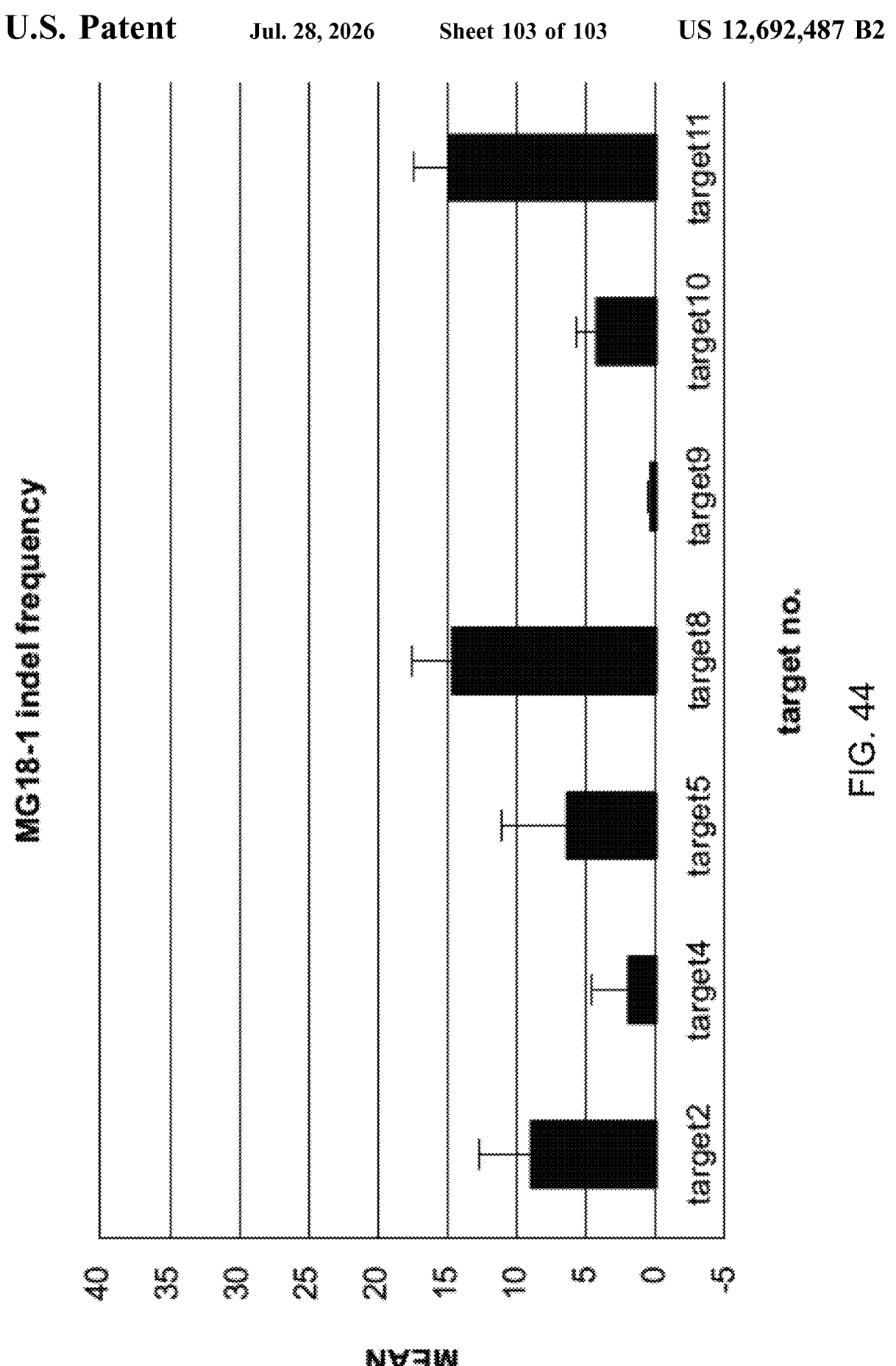
FIG. 44 depicts in cell indel formation generated by transfection of HEK cells with MG18-1 constructs described in Example 17 alongside their corresponding sgRNAs containing various different targeting sequences targeting various locations in the human genome.

MG18-1 target loci were chosen to test locations in the genome with the PAM nRWART (SEQ ID NO: 5537). The spacers corresponding to the chosen target sites were cloned into the sgRNA scaffold in the mammalian vector system backbone 1 described in Example 10b. The sites are in Table 12a below. The activity of MG18-1 at various target sites is shown in Table 12a and FIG. 44.

TABLE 12a

Activity of MG18-1 at various target sites

| target ID | target sequence | Target sequence SEQ ID NO: | PAM | locus | % NHEJ (mean ± std) |
|---|---|---|---|---|---|
| target2 | tgcttattatggacaagtagca | 5763 | agaaat | Fibrinogen | 9.003 ± 3.70 |
| target4 | tccctgaagatgctcacagttt | 5764 | gatagt | IVS40 | 1.99 ± 2.56 |
| target5 | ttttatttctcctgcatatgat | 5765 | gatagt | IVS40 | 6.303 ± 4.82 |
| target8 | tgtggggcaaggtgaacgtgga | 5766 | tgaagt | HBB | 14.897 ± 2.73 |
| target9 | atggtgcatctgactcctgagg | 5767 | agaagt | HBB | 0.387 ± 0.32 |
| target10 | agaacagcccagaagttggacg | 5768 | aaaagt | VEGFA | 4.3 ± 1.29 |
| target11 | tcctccgaagcgagaacagccc | 5769 | agaagt | VEGFA | 15.22 ± 2.40 |

Example 18—Characterization of MG21 Family Members

PAM Specificity, tracrRNA/sgRNA Validation

The targeted endonuclease activity of MG21 family was confirmed using the myTXTL system as described in Example 6. In this assay, PCR amplification of cleaved target plasmids yields a product that migrates at approximately 170 bp in the gel, as shown in FIGS. 17-20. Amplification products were observed for MG21-1 (see gel 11 lane 2) (SEQ ID NO: 1512). Sequencing the PCR products revealed active PAM sequence specificities detailed in Table 13 below.

TABLE 13

| Enzyme | Enzyme protein SEQ ID NO | sgRNA SEQ ID NO: | Synthetic (single guide) PAM | Synthetic (single guide) PAM SEQ ID NO: |
|---|---|---|---|---|
| MG21-1 | 1512 | 5473 | nnRnR | 5524 |

Example 19—Characterization of MG22 Family Members

PAM Specificity, tracrRNA/sgRNA Validation

The targeted endonuclease activity of MG22 family members was confirmed using the myTXTL system as described in Example 6. In this assay, PCR amplification of cleaved target plasmids yields a product that migrates at approximately 170 bp in the gel, as shown in FIGS. 17-20. In the assay shown FIGS. 17-20, active proteins that successfully cleave the library result in a band around 170 bp in the gel. Amplification products were observed for MG22-1 (see gel 11 lane 3) (protein SEQ ID NO: 1656). Sequencing the PCR products revealed active PAM sequence specificities detailed in Table 14 below.

TABLE 14

| Enzyme | Enzyme protein SEQ ID NO | Native (dual guide) PAM determined | PAM SEQ ID NO: | tracrRNA SEQ ID NO: | sgRNA SEQ ID NO: | Synthetic (single guide) PAM determined | Synthetic (single guide) PAM SEQ ID NO: |
|---|---|---|---|---|---|---|---|
| MG22-1 | 1656 | N/A | N/A | 5510 | 5474 | nnRCnT | 5525 |

Example 20—Characterization of MG23 Family
Members

PAM Specificity, tracrRNA/sgRNA Validation

The targeted endonuclease activity of MG23 family mem- 5
bers was confirmed using the myTXTL system as described
in Example 6. In this assay, PCR amplification of cleaved
target plasmids yields a product that migrates at approxi-
mately 170 bp in the gel, as shown in FIGS. 17-20. Ampli- 10
fication products were observed for MG23-1 (see gel 11 lane
4) (SEQ ID NO: 1756). Sequencing the PCR products
revealed active PAM sequences specificities for these
enzymes detailed Table 15 below.

TABLE 15

| Enzyme | Enzyme protein SEQ ID NO | tracrRNA SEQ ID NO: | sgRNA SEQ ID NO: | Synthetic (single guide) PAM | Synthetic (single guide) PAM SEQ ID NO: |
|--------|--------------------------|---------------------|------------------|------------------------------|------------------------------------------|
| MG23-1 | 1756 | 5511 | 5475 | nRRA | 5526 |

Systems of the present disclosure may be used for various 25
applications, such as, for example, nucleic acid editing (e.g.,
gene editing), binding to a nucleic acid molecule (e.g.,
sequence-specific binding). Such systems may be used, for
example, for addressing (e.g., removing or replacing) a 30
genetically inherited mutation that may cause a disease in a
subject, inactivating a gene in order to ascertain its function
in a cell, as a diagnostic tool to detect disease-causing
genetic elements (e.g. via cleavage of reverse-transcribed
viral RNA or an amplified DNA sequence encoding a 35
disease-causing mutation), as deactivated enzymes in com-
bination with a probe to target and detect a specific nucleo-
tide sequence (e.g. sequence encoding antibiotic resistance
int bacteria), to render viruses inactive or incapable of 40
infecting host cells by targeting viral genomes, to add genes
or amend metabolic pathways to engineer organisms to
produce valuable small molecules, macromolecules, or sec-
ondary metabolites, to establish a gene drive element for 45
evolutionary selection, to detect cell perturbations by for-
eign small molecules and nucleotides as a biosensor.

While preferred embodiments of the present invention
have been shown and described herein, it will be obvious to
those skilled in the art that such embodiments are provided
by way of example only. It is not intended that the invention
be limited by the specific examples provided within the
specification. While the invention has been described with
reference to the aforementioned specification, the descrip-
tions and illustrations of the embodiments herein are not
meant to be construed in a limiting sense. Numerous varia-
tions, changes, and substitutions will now occur to those
skilled in the art without departing from the invention.
Furthermore, it shall be understood that all aspects of the
invention are not limited to the specific depictions, configu-
rations or relative proportions set forth herein which depend
upon a variety of conditions and variables. It should be
understood that various alternatives to the embodiments of
the invention described herein may be employed in practic-
ing the invention. It is therefore contemplated that the
invention shall also cover any such alternatives, modifica-
tions, variations or equivalents. It is intended that the
following claims define the scope of the invention and that
methods and structures within the scope of these claims and
their equivalents be covered thereby.

SEQUENCE LISTING (5769 sequences)

SEQ ID NO: 1 - protein, 1025 aa, unidentified
  REGION 1..1025: note = Description of Unknown: uncultivated organism with predicted taxonomy: Candidatus Melainabacteria
  REGION 1..1025: note = MG1-4 effector
MKKKVFAFDLGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 2 - protein, 1077 aa, unidentified
  REGION 1..1077: note = Description of Unknown: uncultivated organism with predicted taxonomy: Verrucomicrobia
  REGION 1..1077: note = MG1-5 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKAEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDKTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLCKTKDDAERFKDLSKDGCGAYRKSKSHKGQFIWKDNKGNYLVAPVYIYSSKQKVYAELKNNPKCMGICDFFKTGCLVKISNEVVDEKKNRLWLKAGFYNLNSIAKEKRVYLTDVNGQEHKKIPLQHLMNAGMKRVETNTI

SEQ ID NO: 3 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-6 effector
MEKEKNNHVWGFDIGKGSLGEAVRVGGDFKHIASVLLDPEFGEIKTAALARRQMRTRKAHKAREKWLEECLDGTGVEILKRREVGIVDGQWRLISKGDERLEREFPPNGEEVCYNSIALRCKLLLGEKLEGWQVFKALNSAIQKRGYDENIPWGEAEEKSSKKDEDDYAQKLSQYEREKSELFESFADGEKYDFPCFFKAYKMGLWSPENPRRVEVRIDCRAQKAKSYVVARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIASGAKYKMTKTAMKKFLKSISATALGDDYAEIEPPKESGRASFSRPAMDILKELIFSGMPPREFYGRKIPEISNTDKNKGVVASDLDFIKLMGDCPWGGIFIPDVQTYQFANAAFPNPDAQINKLIGSQNNPIVRHRLTFFFERIKFLESKYGVPDKVVLEFVRDDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVLRVLVYYGEADEYKDLSKDGCGAYRKGDGHKGQVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 4 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-7 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 5 - protein, 1294 aa, unidentified
  REGION 1..1294: note = Description of Unknown: uncultivated organism
  REGION 1..1294: note = MG1-1 effector
MWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 6 - protein, 1031 aa, unidentified
  REGION 1..1031: note = Description of Unknown: uncultivated organism with predicted taxonomy: Verrucomicrobia
  REGION 1..1031: note = MG1-2 effector
MTWAFDLGLGSIGEAVQQKGEFKHAASWLVPSEFASTKAARTRRRMWRTRQAHKARESWLNQCLRSAGMEVLVGRRVERGPQGWTTLPGDPRLEREFPSAGDTTCYNSALLRIRLLRGETLAPWQVYKALHAAIQRRGYDPNIPWKSGASRSTEEKEEGETRARAAEYQSLLEDMAPGRTEFHYPCYLQAWKMRLWNPGQPEVLQERVSHDAESIHGMVAPRTLVEKEVRDLVAAAARYHPQLAGQADFILWGPACKPYASHNGTLRKQHGLRQGSEEDWEGVMGQKIPRFDNRIIEKCALIPRFNVCKMAPEGRAAAQPDAALPREVAFLMKLKNLRFSRGGGIAHLEAAEIATLFEKRREALSLTQKQWETACEKLGGRPLPPDLEVKAPRLGGRSAFCRPALKHVKELILSGKSPRDFHAEALARLHGNTNPQKGLVPADLDFLLRMGDSWEGLYLPNKRLEAISSRARTPDEAIREVIGSVNDPIVRHRLQLFVERLDELETRFGPPDQVALEFVREDFMGEKAKIEYRKFLNRREKERKEAREQAGQLGATSGSSGLKMELFKAQRGQCLYSGQRLHETKIEDYVIEHIVPRAKRGPDAVINYVLTTEELNNDKSDHIPFEWPYLKKQWDAYTQRVESCAGALGVKRVRLLVSPDAVELAQKYTALAETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEKGKLEETIYARRTIAGNSVAAVRQEFRALAFKSVGINKTEFNLDYLYKQTDKILEPRIRQLVQDFASTEPNEAAWERFCDEVRLPRKDGHPGPHVRRVRMRVGPMDEFKNLSKDRAASGAYRKGSTHHGQWVYRDATGRSLVRPVYAFESAGQVRRELIAMHGLDALVGYFQSGCLVELVRPVAHKKTPLAPGQFSLNTLRKDGFAVVTDARGRKSEPISLKTLLESGFHRVTS

SEQ ID NO: 7 - protein, 1200 aa, unidentified
  REGION 1..1200: note = Description of Unknown: uncultivated organism
  REGION 1..1200: note = MG1-3 effector
MNEYILREPDRKPLAEEWLNHEFYRSAVVLGIDIGLEGIGVYLRRGPQEIFARSIMLELPEAEALAERRQKRAWRHCRKNRKRRLHRLKQLFAKHGLPWLDADRMSRAHPFRERYRAINNGVASKEALSICIRHCVVHRGYDYGGTEEGTFPWGESPLLSKAAEWLATAYVTPELKEQIEQRAPGLVPGKNEEEQRNKFAELLRERLEWSQQHDIARVLAEHVKGGHDNLRTRARGYNFPRQKVWEHLETIVRKHAHLIDDVEGFLAVLGLNPNKAANAKEAAKARKRAIFFYNRKTRFDMERHWEKKVNRCPFAGKLGGNPDERCAENGDLNVRRWKALEFAATRRVEIEATEGKGATKKKRRCLHSLSASATRKLIEFIEKHHGAASPATAPKWEEGKAIILDDITAVHGEKAKPVAEKQSEWNKSYFTQLKDLLTPTLANRKKRASLSAFAAGHLFNIATADSSDFAPENVVTRLREAGFYDWRRNASVDFNPFPQVELLLGRRIKHGKRRGELSPTCQGLLRRIFAEHREALGGATAPDYCVIEVIGDPPRNARQRAERQKEIEANREKREKLFEQYGIEDSGVASKRRRIMLYEQQRGKCPYTGRDLPSNPLDPSLEIEHIFPVEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQSKTQSLGDSTFWRQVRPDEATVAQRTALKPEEITDADELLTTLQRMNIPAKLIPSRSALADWLAAATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVKLTSQLFKDKEGTPMERFAGDVLSKILSTADDLAYVLGLPPAAEEAQKHGWRIPTSPPPPAAAAKETDGNLL

SEQ ID NO: 8 - protein, 1200 aa, unidentified; identical to SEQ ID NO: 7
  REGION 1..1200: note = Description of Unknown: uncultivated organism
  REGION 1..1200: note = MG1-13 effector

SEQ ID NO: 9 - protein, 692 aa, unidentified
  REGION 1..692: note = Description of Unknown: uncultivated organism
  REGION 1..692: note = MG1-3 effector
MGYGVKEKMKHFHYSIPRTQEKLHYPNKYKVTKAQWKKWCEEKGYKINLGTSEIPAPKISGRTGFSRPTMLLLREFILSGLGAQDFREKILTTNFKGFEKFKLQEEDLDFLKNIKNNDPQNIYLPNNSLKEKFLNKNTGDMEEAVQKLIGSTRHSVVRHRLTIFFKELQKLEKKFGAPDQIVIEFAREDFSTKDSKKKYENDSKENNRIFEAAKKELQEKFGIDYRRQNENLVRKYMMWEKQGYTCPYTGQALSFEKLPEYEIEHIIPRGNKWNGPDDIKNTVLTTGTENRKKGDNMPFEYIKNEEWEAFKERVNNMKISGKTKNILFARTKEEAEKLIDRYYGLATTGWVARMARDIACLWFGWQPNAEGEKRKLHTVSGSLVGKVRRKFGLNKALNPFLSEADAGKDEKNRDDKRHHALDAMVMTYLDEYMRNPRNFSKLQKELGEMFGKLGGAQYFEERLAEVTPYKIARNKAKLGETAYRKIEVQEKIIKRGKPEIKKEEIIVTRKNIEDAKPKEIIDKNIAKKIDDFLNKKPSEEEKKEFYKKLGIKKITVKKGKPDNLKNLSKNPNARGQYYESKSITGTGTLQHGVYLYSRDGENWKVEPVYAFKSPYKTKKELLEQGFQIKDNALFYAGCIIEVTENIEGKDIDRGKYTAMTIKTAGTIKLRNYKGDIIQTSLPQLKNNFHFIK

SEQ ID NO: 10 - protein, 692 aa, unidentified; identical to SEQ ID NO: 9
  REGION 1..692: note = Description of Unknown: uncultivated organism
  REGION 1..692: note = MG1-3 effector

SEQ ID NO: 11 - protein, 1271 aa, unidentified
  REGION 1..1271: note = Description of Unknown: uncultivated organism
  REGION 1..1271: note = MG1-8 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVKQARAQGKTPEELEAEEQKQLEQADPRYREAAGKWPEFKRAVPAEFHFPCYYDAFHMGLWSPDQPDQLRLRLDHRAASTRNVRFDRANVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVYARLEKDRAGRLTGKLVPDSLLASEVTFLLKLKNLLVADPVKGQRKLTVEEVRDIFAFAQRRLKTLPLFTPEGEPAKEWPSKVANCFAINPSDWPKIAVETECLKGLARLTVSDNGAPRPLTREEAEALLHAVAGGRRAAQSALPAHLLPLVKRAAAAWKQAKQQAGEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPLVRHRLGVFDERLRKLRFGDARKGLRGFGVPEAIVLEFVREDFMGEQAKRELQTFQKRREQARAEAEAEAAKLGLESRSSALRYELFKAQGGICLYTGRPLSETQLDQYEIDHIVPRSLGGPDAMVNYVLTFPEVNSAKEKGKLTPYALLHGTDGWDAYVARVKARAAALRNKKVQLLTREDAPELVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEPCALADTIYGRRLDKGEPVIVQRVPVRELAYKQEQQRPVFNLTYAKDQIAHLRDPRLRRVLEALVATGPDQVAWDNYCRALAAGTCPELPGRKVLKVTLNRDEDPAEFKDLSKDGCGAFRTRKGEHRGQFVYLDARGRVRVRPVRPFESLVAVKAEVERLAAGGRLIGFFQSMCPVELDQPVTHGNFVLRPGTYRLNTIKKDGRAQVTTAAGEKTPQINLAKLVAAGFRRIA

SEQ ID NO: 12 - protein, 1655 aa, unidentified
  REGION 1..1655: note = Description of Unknown: uncultivated organism with predicted taxonomy: Verrucomicrobia
  REGION 1..1655: note = MG1-9 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 13 - protein, 1147 aa, unidentified
  REGION 1..1147: note = Description of Unknown: uncultivated organism
  REGION 1..1147: note = MG1-10 effector
MTHYYQFNSIPDAVSPNSESLEQLKSASARYWAEHDFFSSDTVVLGLDIGMEGIGICVRKGKDILYCKSLLVDLPESEALAKRRAFRASRHVRKNRRRRMRLLKDLFGQYGLPWVDDSIMSRSDPYILRHRAVSKKLASKEALSICIRSLVARRGYDYDAMKEQGNNPWGDSNSVKEVMSWLKTTFVDEKMVQFIKEREEELTEGKGAPLKEETREKLWELLQARKAASDKQDINAMTAAYAKQRISERQAKGMNYPRSMVRKNLEEIIDRHAHLIDDVEGFKASLFRPCVTKEDKGKAIFYYQRKTAEENRLHFEKKVKDCPLAGWLQLGDENSKCCLKGNAWFRLWKLVDFLSVRRFYLKKKEKGSVPIRRLLPASVIESLVKASVHQDDHHFVSGWKDVKAVLNESLACEGWMAIDKGGDVKDQKDWNKEQLIALQDLCSPSASSRQARASLGEASARKLYYMVTQNESNFDPECMEEQKKNCGLYEQRQAISLFGGTFPQVAALLGTIGPDKKNKNGRFVQKTTGILQRIFADLSPMIGGKKVPDYVVVECIRQAPRTETQKKEIEVEQKNNRASKDKMASEFGVGEGKLGRSKYFRIALWKQQGGSKTTKAICPFTGKTLDVDDPLSPQLELAHLYPDTKGGLYMMDNLVLTTREVNKAMDNMTPVEAARAGIFGISCDEMIRRSEQFAWGESKRKLFRFEPTAEESFPDFNNMTRISQLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSESKYKALGDSTFWHVDEEGNTWQRTPLVLGKDTSADSLHAMLVASCIPENLIPSQSEIDKWISHHTPAHRGEEIKNIPLRLKNGVPVKSIWKEASKGTLINSPMGWSGTMSDDGIFREARSLRSSNDRLELWIGWNAKKQVWEYQTRVVPTREAMAGIRRMGLPWRNTKNIPPYLQKILKQKKVSSLKELISGKLCPHSIHVADIRKGMVAKIEFEYDVKKCPSDKNGLKEVMWGEVTAILTSGKVECKSLIRKDMKPYSATNSLKIAMLFGFPPPDEFAKTHSLKP

SEQ ID NO: 14 - protein, 1206 aa, unidentified
  REGION 1..1206: note = Description of Unknown: uncultivated organism
  REGION 1..1206: note = MG1-11 effector
MNNTPLSPNTASAEPEPDRKLAAESAAENAQARAVAASWAQHPFFDDESIVLGLDIGMQGIGIAVRRGRQLLYAKTLMVELPESAPLRQRRQYRAARHARKNRKTRMRRLRELFLRHGLPWVSDEIYGRSDPYKLRARAFTPGKTLASKEALSLCIRSVVAHRGFDYYALCSESGGYPWGESSDMKDAARWLRTQYVTEETRDQLIGMAGAFSCFDEKEITDNHLLEWERLVRERCDDPNKPDLATLLRQYASSRPDDRRARGWNFPRSLMEDHLRTIINKHRHLIDDCDGFLAALFRPCDTKADKKRAIFHYNRKTPAEARARFERKIALCPYLSDPETAISLGHADAEGRPLPPEKCGTRGEAAICRWSMLDFLSTRRFELKPPKARGKDLAEPPLLRQTLPEATIRALDEALQEPVKPRWADLKSRLTKALKPFTLETNTKSPTNALLIEQLKDICCPSGPKAAARAGLSARAAELLIGVITGRSNPAGEASDTPPAPSYDPRQLEERKLAWGLYEKRARIDASRTGIYPQVHTLLGTLRVHRKSAEDSAFSTRGLLQRLFEGELRESLGGKTRPDYCIIECIKNPACNTKQASEIQKQNDARRKRKEELCRAYGCANPTHAEMLRLQLFEEQGGKRKGEAPAICPFTGESLGTDPLSPHLELAHIFPDARGGLYIRENLVLTTARTNRDMNNRTPIEAAEASLPGWSRWETIEQRIRHFRWNAKKLELFTFRPTPEQPIPDFNNMTRTAQLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTGSTRQSLGDSTFWGVNSQGDLTQRTPLVYDKDTSVESIAQDLVRTGIRAEEMPDQDHIEQWLLRMSQAQQEEREGRDAAGPAPTLRLKNGRPIRSIRKGSKKGEIAVSPLGWSGIIEPRSESPAGDGAPAAEATSGRGRDRNRAAITAPNRFIALRCLSSSNDRLELWLGHDGKKWKYVTRVIPTKQALAGLKRMGLPWRGRERAPLYLIRLLDAARCRDLKQFICGTLPPHAVKVATVRKGDFFRATFNLKPKKREEQHSHTACLDTPATLTGWGKVTALMTKGQIGISPATHQGYEKTSVRGPSRLAKMLGLQEDAAAEAESRGLLPRP

SEQ ID NO: 15 - protein, 1244 aa, unidentified
  REGION 1..1244: note = Description of Unknown: uncultivated organism
  REGION 1..1244: note = MG1-12 effector
MDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 16 - protein, 1294 aa, unidentified
  REGION 1..1294: note = Description of Unknown: uncultivated organism
  REGION 1..1294: note = MG1-14 effector
VWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENFFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELWKAQGCCCLYTGRALAETELDQYEIDHIVPRSLGGPDAIVNYALTFHDINHTKEKGKLTPFTLLHGKPGWAEYLLRVDARATFLRNKKVQLLTRPDAAELVQRYTALAETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFERAALADTSFGLRVEGGKRIIVKRVSLFDLAQEPAGAPGKTKFSSKYLLKKIEWVRDATIRRRVKEEFLHKEPTEPNWQKFCDSFRQNSRNGVPGARIMKVWVYAGEPNEFKDLSKDGEGAMRKAKDDHQGQIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 17 - protein, 1010 aa, unidentified
  REGION 1..1010: note = Description of Unknown: uncultivated organism
  REGION 1..1010: note = MG1-20 effector
MNTKKIIFGFDVGLGSLGEAVRQGDKIIHADSLLIDKEVAEIKDQAERRRQYRTRTTHKEREKWWKKIWKMIGKQPLKGIEVFKDKNGNWQAEKGDEKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQEWYEKAEGERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKEQKILLKPNGAINLSKDKKSRPRWYVTKTGEGFSYEGHYIFKERNNENFKICPVKAFESSWQVFRKLKNKGYEIKDNALFYAGCIIEITKPIPKKDIDVGFYEIKSLKPSDHRIQLKSLKRGEVFPLFAISYLKNNFHFVQ

SEQ ID NO: 18 - protein, 774 aa, unidentified
  REGION 1..774: note = Description of Unknown: uncultivated organism with predicted taxonomy: Candidatus Peregrinibacteria bacterium CG10_big_fil_rev_8_21_14_0_10_54_7
  REGION 1..774: note = MG1-21 effector
EKLEREFPKKGDDTVYTSCLLRILLLQGEKLKDWQIYKAVRSAFMRAGYPNVPWAKQDEKEEEKRATEFTEMLEKIFTNLDYRFPCYYDAYQMEIFDAETGEIEIRQKKKANRARGYTAPRDLVEKELRLLLEQAAKQIPDLKNMPAKDWKDYILFGLKGDEKLQNKQWKGFYDTKIRGILDQKKAKFDNRCVNNCSQIPRFRVSRTKNILYFQTHLLLKLCNMMVEKNKKNEKLTPEERQERYEKAEEERKQYMKDFFAKGGKKLTEDDYKKIANKYKITKTQWKKWCEKKGYKTYPGTCEIAAPKISGRTGFSRPAMLLLREFILSGLGAHDFRKKVLLENFKGFEKYKLHKEDLDFLKNIKGNDPQNIYLPSISLKEKFLDKNTGDIEDAVQKLIGSTRNSVVRHRLSVFFKRLQELEKKFGTPDNIVIEFAREDFSTKDSKKKYENDSKTNNKLFLEAKKKLRDNFGIDYRKQNENLVRKYMMWEKQGHICPYTGQPLDFEKLPEYEIEHIIPRGNKWNGPDDIKNTVLTTSAENRRKGENMPFEYIKNEEWESFKNRVNNMNISGKTKNILLARTEEEVEKLINRYYGLAVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNKARLEAQAISSVKKKISELKKTDIESIIDYKMKIEIQEIGLKNFQKKHSKE

SEQ ID NO: 19 - protein, 774 aa, unidentified; identical to SEQ ID NO: 18
  REGION 1..774: note = Description of Unknown: uncultivated organism with predicted taxonomy: Candidatus Peregrinibacteria bacterium CG10_big_fil_rev_8_21_14_0_10_54_7
  REGION 1..774: note = MG1-22 effector

SEQ ID NO: 20 - protein, 809 aa, unidentified
  REGION 1..809: note = Description of Unknown: uncultivated organism with predicted taxonomy: Candidatus Melainabacteria bacterium
  REGION 1..809: note = MG1-23 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKE

SEQ ID NO: 21 - protein, 1036 aa, unidentified
  REGION 1..1036: note = Description of Unknown: uncultivated organism
  REGION 1..1036: note = MG1-24 effector
MGKKVFAFDMGKTSIGFCVREALEIKEANSIIIDKEHSDISSIRERRRVKKNLEAHKAREAFFINLWKSCGLIPLDTKDENFKKEFATKHEDVIYTSCLLRIALLQNKKLEQWQIFKALYNAIQRRGYDTNLAWKSAQSDDDKENQELVKKYTQENGIEMIQNEEYKYPCYYDAKRLGLWNETTPKVCKRTLNNENLIKIRTTTYVAPRQLIEKELCNLWKNAQAQIPELNKYTVEEFLYGEYKEPYGSFVNPKFKQYMGTNHDWQGVLGQKIPRFDNRIIAKCKLLPKRNVCKANTIENVSLVLLMKLKNLRLTILDGSKRILAPAEIKHIYENWLSKVEQNVIKMQEKCKKENKTPDKEDKKLDTTITKKEIENVINQVISDKIEPLKANISGRSAFCKRACQIINKFILGGYLYPNEMDITEFIDSENRPNGITKAEIQNMLSKIGDWNNLFIPDNRGETIDNSENIRVKTDLMIGGITNPIVRNRLQIFRDLLLSLERDYGKPDEVIFEFVREGADNSLFGKAKAQAAETNMREMEKRNQQLIEELKNYDAYSSKNFEKLKLLKIQCGQCAYSGEKIGIGDFNKCEIDHIYPRAMGGNDALYNKVLCYRVENQKKQDRTPYEWLSSNKEQWANYVFRLNKIKQSLGKKKFELLTSKPEDCAKLIDSYNGLAETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKKPFKGNIRPLETIYGLRTYGNNSYITQRIPLESIEQKDKKIKTIIDEAIKNDLLEKLTQKMDSKDWIKMLQNYVHPTKKTKVKKVMVVVSEGKIEKDSNGKERIGEFCDFGTKGTNHQFKHSKGHKGQILYFNEKGSVKVMPIYANIKTQDVKDKLLALGCKLYNKGEMFYSGCLIEVEKPFNATVYYKETDENGKDKTISVKQEVPAGIFKLRTIMSNGAIKLENNCGMEILSSAKVLVEANMKKYKN

SEQ ID NO: 22 - protein, 1027 aa, unidentified
  REGION 1..1027: note = Description of Unknown: uncultivated organism
  REGION 1..1027: note = MG1-25 effector
MVKKIFAFDMGKSSIGYCAREGLKVLELGSLIIDKDHAEIVSNRDRRRVFKTLNAHKAREKFFNDLWKSCNLEPLEKEDKLFKKEFGKKDEETIYNSTLLRIALLQNIELEEWQIYKALHSAIQRRGYDTSLAWANANTDDEKENKKRTLEYTTNKENDELISQEEYKYPCYYDAKRLGLWEEENPKTLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTRVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPKKEILPAGIYKLRTLKSDGRVQLESSVGIEIWTNAKNLVDTDFKKLTK

SEQ ID NO: 23 - protein, 1025 aa, unidentified
  REGION 1..1025: note = Description of Unknown: uncultivated organism
  REGION 1..1025: note = MG1-26 effector
MKKKVFAFDLGKASIGYCVREGFEINEANSIIIDKDHAETMSLRDRRRIKKTLDAHHAREEYFNKVWSGVGLNILDKNNNNFKKEFPSKNEDIIYTSCLLRIALLQNQKLEQWQIYKALYNAFQRRGYDVNIAWKSVQTDDDKENIERMKKYTCENDIELIISDEYKYPCYYDALRLGLWNEDEPTKLNHSIPQHNSNKIRTTEYVAPRELVEKELKQLWLNAQLQLPQLNSISPEEFLYGEYKVPYGSCTEKEFKQYRGTERDWQGVLGQKIPRFNNRIISKCKLLPKRNVCKANTLENVSFVFLMKLKNLRFTTVSGEKLRLSPTEIKQIYENWLLKVENAYDKDIEKANNLGKEKPEKRLNINITKKEIENVICNEIIDKIEPMKADISGRSSFCRRACQIMNKIILDGELYPQNVDISEFVDRDNVKNGITEEEIQSMLSKIGDWNNLYIPDNREENAQNASNSRTKTDIMLGNITNPIVRNRLQIFRDLLLDLAEKYGTPDEVIFEFVRDGADNSLYGSKKAQDTEKYMKQQEKENEQIIKELKEAGLYVNGQNHANATYFLMHKLLKSQGGACAYSGQKIAPSNYDECEIDHIYPRTLGGNDALYNKVVCYRRENQDKKGRTPYEWLSSDNDKWANYVNRLNKIKKQLGKKKFELLTSKPEDCEKLIESYNGLAETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDKPFKGNTKPLETIYGLRTYGEKSYITQRVELNSIDKKATKIKSIIDETIKNDLLNKLEENPTEQEWKLMLQNYIHPKKQTKVKKVMIIVSEGEITKDSNDRERIGEFVDFGTKGTQHQFKHSKGHKGQILYFNQKGIVKVMPVYSNIKITDIKDKLQNMGCKLYNKGQMFYSGCLVDIPKPFKAGSKEHPAGCYKVRTITLGGQIKLEDNCGIEILTSATYLVQAGFKKVESK

SEQ ID NO: 24 - protein, 1028 aa, unidentified
  REGION 1..1028: note = Description of Unknown: uncultivated organism
  REGION 1..1028: note = MG1-27 effector
MNKKVFAFDLGKASIGYCVREDLKILEAGSLIINKDHAECISNRDRRRVQKTLLAHKKRESFFNNLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPTTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDENGNDKQIPTKEKLQAGVYKLRTMMIDGKVKLESSTGIELLTNAKVLVEADFSKFSKY

SEQ ID NO: 25 - protein, 1036 aa, unidentified
  REGION 1..1036: note = Description of Unknown: uncultivated organism
  REGION 1..1036: note = MG1-28 effector
MGKKVFAFDMGKASIGYCAREDFEIKEANSIIIDKDHSDISSIRDRRRVKKTIIAHKAREQFFVNLWKSCNLTPIDTKDDNFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEASIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDADGKEKTISVKQEVPYGIFKIRTIMGDGKIKLENNCGLEILSSAKVLVPLNMKKYKN

SEQ ID NO: 26 - protein, 1036 aa, unidentified; identical to SEQ ID NO: 21
  REGION 1..1036: note = Description of Unknown: uncultivated organism
  REGION 1..1036: note = MG1-29 effector

SEQ ID NO: 27 - protein, 1036 aa, unidentified
  REGION 1..1036: note = Description of Unknown: uncultivated organism
  REGION 1..1036: note = MG1-30 effector
MGKKVFAFDMGKASIGYCAREDFEIKEANSIIIDKDHSDISSIRDRRRVKKTLNAHKARERFLVNLWKSCNLIPLDTKDDKFKKEFANKKDSTIYTSCLLRIALLQNKKLEQWQIFKALYNAIQRRGYDANLAWKSAQTNDDKENIELTQKYTQENGIELIKNEKYKYPCYYDAKRLGLWDENFPNRFNQAINLDNVIKVRTTTYVAPRQLVEKELKQLWINAQIQIPELNKYSVEEFLYGEYKEAYGSYVNPEFKKYMGTAHDWQGVLGQKIPRFDNRIIAKCKLLPKRNVCKANTIENVTFVLLMKLKNLRITNNLGEKIILSPEEIKHIYENWLSKVEQNVIKMQEKCKKENKTPDKEDKKLDTTITKKEIENVINQVISDKIEPMKANISGRSSFCKRACQIMNKFILGGYLYPQEMDITEFIDSENSPNGITKQEIQVMLSRIGDWNNLYIPDNRGENINDSEKIRTNTDLIIGSITNPVIRNRLQIFRDLLLSLEKDYGKPDEVIFEFVREGADNSLFGKAKAQAAETNMKAMEKQNQQLVKELKNYDAYSSINFEKLKLLKMQCGQCAYSGQKIGISDFDKCEIDHIYPRTMGGNDALYNKVLCYRVENQKKQGRIPYEWLSSDKEKWANYVFRLNEIKKSLGKKKFELLTSKPEDCEKLIDSYNGLAETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKKPFKGNTRPLETIYGLRAYNGKSYITQRVPLESIEPKEKKVRTIIDEVIKNDLLEKLNQKIDSKEWISMLQNYIHPKKKTIVKKVMIVVSEGSIEKDSNGVERIGEFCDFGTKGTKHQFKHSKGHKGQILYFDEKGLVKVMPIYSNIRTQDIKDKLMTMGCKLYNKGEIFYSGCLVEIEKPFVATVYYKETDTDGKEKTISVKQEVPDGIFKIRTIMGDGKIKLENNCGLEILSSAKVLVPLNMKKYKN

SEQ ID NO: 28 - protein, 1028 aa, unidentified
  REGION 1..1028: note = Description of Unknown: uncultivated organism
  REGION 1..1028: note = MG1-31 effector
MNKKVFAFDLGKASIGYCVREDLKILEAGSLIINKDHAECISNRDRRRVQKTLLAHKKRESFFNKLWQNCDLNILNKDDKRFSTEFGKKNDSTIYNSTLLRIALIQNKPLEEWQIYKALHNAIQRRGYDSKLPWANAKSDDDKKNEELSARYTQNEQGEELIKNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSILSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSKPENCEELIKSYNGLAETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHYITQRVSLETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSHIEQNGCKLYKKGMKFYSGCLIQINKDFEATAYYTQTDGNGNDKQIPTKEKLQAGVYKLRTMTEAGQIKLESSTGIELLTSAKVLVEADFSKFSKY

SEQ ID NO: 29 - protein, 1028 aa, unidentified
  REGION 1..1028: note = Description of Unknown: uncultivated organism
  REGION 1..1028: note = MG1-32 effector
MNKKVFAFDLGKASIGYCVREDLKILEAGSLIINKDHAECISNRDRRRVQKTLLAHKKRESFFNNLWQNCDLNILNKDDKKFSTEFGKKNDSTIYNSTLLRIALIQNKPLEEWQIYKALHNAIQRRGYDSKLPWANAKSDDDRKNEELSARYTQNEQGEELIQNENFKYPCYYDAVRLSLWSENMPEKLQTYVPLDNVKKIRDAGIVAPRNLVEKELKQLYINAQLQLPQLNKYSVEYFLYGEGEVAYASYNKKDYKCHRGTEWDMQGVLGQKIPRFDNRIIAKCKLLPKRNVCKANTLENVSFVLLMKLKNLRYTNINNEYSMLSADTINKIYQNWLNKALKDDGSYKLDTTIIQKEVEKVLGEKIQDKFEPLKANISGRSSFCRRACKIMNHIILNGIEDPSTMDVAEFTDNIDTPNGITEAEIRTMLSKIGTWENLYIPDNRYEMAELSSDNREKTDILIGNITNPIVRNRLQVFRDKLIELKQKYETPDKIIFEFIRDGADNSLYGAKKAQDFLKTIKENEKTNNDLAIELKNADCFSVVNLEKLKLLKQQDGICIYCGQRIGISDLDKCEIDHIYPRSRGGNDAISNKVLCYSIENQKKKDRTPYEWLHNDERTWADFVNRAKLLKDKLKKTKYTLLTSNPENCKELIKSYNGLAETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDKPFKGNTKPLETIYGYRCIDNKHCITQRVSIETIEQKDKKIKCIVDEVIKNDLLEKIKEKMPTKDWTTMLQNYIHPTKQTKVKKILVIVSEGELTKDSNAHSRIGEYADFGTKGTKHQFKHSKGHKGQILYYNEKGVIKVLPIYANQKDSDVKSYIEQNGCKLYKKGMKFYSGCLIQINKDFEATAYYTQTDKNGNDKRIPTKEKLQAGVYKLRTMTEAGQIKLESSTGIELLTSATVLVEADFSKFSKY

SEQ ID NO: 30 - protein, 1028 aa, unidentified; identical to SEQ ID NO: 28
  REGION 1..1028: note = Description of Unknown: uncultivated organism
  REGION 1..1028: note = MG1-33 effector

SEQ ID NO: 31 - protein, 1025 aa, unidentified; identical to SEQ ID NO: 23
  REGION 1..1025: note = Description of Unknown: uncultivated organism with predicted taxonomy: Candidatus Gastranaerophilales bacterium HUM_9
  REGION 1..1025: note = MG1-34 effector

SEQ ID NO: 32 - protein, 1027 aa, unidentified; identical to SEQ ID NO: 22
  REGION 1..1027: note = Description of Unknown: uncultivated organism
  REGION 1..1027: note = MG1-35 effector

SEQ ID NO: 33 - protein, 1011 aa, unidentified
  REGION 1..1011: note = Description of Unknown: uncultivated organism with predicted taxonomy: Clostridium
  REGION 1..1011: note = MG1-36 effector
MRYRIGLNIGINSCGWAVIEHNEDGEPIKLENMGVRMFEISENLKDGLSLSKAPRETRSIRRRIRRRKHRIERLKYLIVNSNMLTQEEVNNLYNSTNLENIYLLRVRALSEKISNTDLTRVLINLMKKRGYKSNVELEDYAKDEDGKVLTATKENQKIMKEKGYSTVAEMYLKDKKFKMILPDGTIIYKIRNTTGNYSSTVLRNQIREELIRILIKQQELNDLVTNDFVQKCLEIFDSQRPYDEGPGLRYSTTQVDKMLGKCIFEKQENRAVKASYSFEYFDFLKQLNNIIIEKTIITSNNKTTQKRKLSKEERQKIIKLAKYQSQIRYYDIRQELQLSDYERFCNLEYSSISEFSESINKLAERKPKLEGFTSYFRIKQALYYVDNTLIERLSNEELDEIAYVLTVYKSNERRLEQFEIRNLHLPANAIQELLKISFIEIAYLSLKAIKKITPYIEEGYTYNSALEQAYPSFETSLCNINSEILNPVCRRAISQSIKVLKAIVNQYGKPDLINIEFSNELGKGKSEREKIKKQKQENLGKTSRIKEELQAQGIENPTGTEITKYKLWKEQTNYCMYSGKKIDIEQVFSSETQINYIIPFWMCFDDTYKNKILTFTSEVKQKQDLMPYQYIQKMRRDTEEYETRISMLIRVYSKKNRLVKKNITKEEMIKWRNRNIEDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRKVTGQAHDETIRRMQICGKEIKCISRTDIKKLKLNSEGEIENFSKNSKNTDKVLYNALKEEIKENGGNATRSFIKQFYKPKKDKTPGLPVKKVKLESKTRLPIKLKNQAIATNGSIIRLDVFKVENEGYYYVPIYVSDTVLPKLPNKACASSKPYEEWPEMREEDFIFSLYSRDLIYIKNKSPMNLHPTDGKRKHSNNRRNISVLHKGRYLRSNHKHNKQW

SEQ ID NO: 34 - protein, 1027 aa, unidentified
  REGION 1..1027: note = Description of Unknown: uncultivated organism
  REGION 1..1027: note = MG1-37 effector
MVRKIFAFDMGKSSIGYCAREGLKVLELGSLIIDKDHAEIVSNRDRRRVFKTLNAHKAREKFFNELWKSCNLEPLEKEDKLFKKEFGKKDEETICNSTLLRIALLQNIELEEWQIYKALHSAIQRRGYDTSLAWANANSDDEKENKKRTLEYSTNKENDELISQEEYKYPCYYDAKRLGLWEEENPKMLKTYVDVYNNDKIRTAGIVAPRNMVEKELKQLYINAQKQLPELNKYSADYFLYGVSEKAYATYLDSDYKKYRGTNWEWENGGVLGQKIPRFDNRIIAKCKLLPKRNVCKAETVENVSLVLLMKLKNLRFTDVLGEKSMLSAEAIKQIYENWQKKATKNDGSIKLDTTITKQEIEKVIGEKILEKFEPMKAKLSGRSSFCRRACKIMCKIILEGIENPATMDVGEFIDNIDVKNGITEKEIRTMLSKIGTWDNLYIPDNRYEMAEISSDEREKTDILIGNITNAIVRNRLQIFRDKILELKYKHGTPDEVIFEFVRDDNSLFGAKKTQEYISNINKNQKENEEIAQQLKDANCFSSKNLEKLKLLQKQGGHCIYSGRPIAISNLEECEIDHIYPRSRGGNDALSNKVLCYAIENQNKKEQTPYEWLHNNEHSWNEFVKRVTNKQEALGKIKVKLLISKPEDSEKLIKSYNGLAETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDKPFKGNIKPLETIYGYRKLGEKTYITQRVDITSIEQKDKKIKSIIDEIIKNDLLAKLEDKMTSKEWANMLSKYVHPTKKTKVKKVLLVVSEGITNFDENGRARIGEFVDFGTKGTKHQFKHSKGHKGQILYYNEKNAIKVMPIYANQKLGEVKDKLEQMNCKLYKKGMMFYSGCLIKVDKEFEGTAYYTIADENGKEKQTPNKEILPAGIYKLRTLMSDGTVKLESSIGIEILTSAKKLAEADFKKLTK

SEQ ID NO: 35 - protein, 810 aa, unidentified
  REGION 1..810: note = Description of Unknown: uncultivated organism with predicted taxonomy: Candidatus Melainabacteria bacterium
  REGION 1..810: note = MG1-38 effector
MSKKVFAFDLGKASVGYCVREGFDIRKVGSIIIEKDHAEITTNRDRRRVKKTLEAHKAREQFFKKLWQNAGLETLDKEDERFKKEFGNKKDKNIYTSCLLRIALLQNKKLEQWQIYKALFNAFQRRGYDANLAWANAKTDDDKKNAEYMAKYTKENNVELINNDDFKFPCYYDAKRLGLWSEENPSELKTTIPLTGSKKVRTNGLVAPRELVEKELKQLWLNAQKQLPQLQNIDAEYFLYGDYRQAYGSYVVKEFRKFRGTKNDWQGVLGQKIPRFDNRIIAKCKLLPKRNVCKANTLENVSLVLLMKLKNLRLTDNMGEKFLLSPIDIKKIYENWLIKAKIDTNEEKLDTTITKKEIETVLNRKIKDKIDPMKANISGRSSFCRRACKIMTKIILSCELYPQNVDITEFVDKPNTQNPITIEEINTMISKIGDWNNLYIPDNRDEMAENSSDNREQTDTLIGNITNPIVRNRLQIFRDLILNLKQEYGTPNEVIFEFVRDGADNSLFGAKKANDTLKVMKENEKDNEQIVSELKDANALSSENILKLKLLKKQGLKCIYSGKSIAISNFDACEIDHIYPRSMGGNDALYNKVLCYSMENQKKAGRTPYEWLHKDEKTWFDFVNRLEAIKDTLGKKKYELLTSKPEDCKILIDSYNGLAETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDKTFKGNIKPLESIYGKRVKNGNTYLTKRADITSLEPKEK

SEQ ID NO: 36 - protein, 1028 aa, unidentified; identical to SEQ ID NO: 28
  REGION 1..1028: note = Description of Unknown: uncultivated organism
  REGION 1..1028: note = MG1-39 effector

SEQ ID NO: 37 - protein, 1028 aa, unidentified; identical to SEQ ID NO: 29
  REGION 1..1028: note = Description of Unknown: uncultivated organism
  REGION 1..1028: note = MG1-40 effector

SEQ ID NO: 38 - protein, 1025 aa, unidentified; identical to SEQ ID NO: 23
  REGION 1..1025: note = Description of Unknown: uncultivated organism with predicted taxonomy: Candidatus Gastranaerophilales bacterium HUM_9
  REGION 1..1025: note = MG1-41 effector

SEQ ID NO: 39 - protein, 1028 aa, unidentified; identical to SEQ ID NO: 24
  REGION 1..1028: note = Description of Unknown: uncultivated organism
  REGION 1..1028: note = MG1-42 effector

SEQ ID NO: 40 - protein, 1028 aa, unidentified; identical to SEQ ID NO: 28
  REGION 1..1028: note = Description of Unknown: uncultivated organism
  REGION 1..1028: note = MG1-43 effector

SEQ ID NO: 41 - protein, 1036 aa, unidentified; identical to SEQ ID NO: 27
  REGION 1..1036: note = Description of Unknown: uncultivated organism
  REGION 1..1036: note = MG1-44 effector

SEQ ID NO: 42 - protein, 1025 aa, unidentified; identical to SEQ ID NO: 23
  REGION 1..1025: note = Description of Unknown: uncultivated organism with predicted taxonomy: Candidatus Melainabacteria
  REGION 1..1025: note = MG1-45 effector

SEQ ID NO: 43 - protein, 1036 aa, unidentified; identical to SEQ ID NO: 25
  REGION 1..1036: note = Description of Unknown: uncultivated organism
  REGION 1..1036: note = MG1-46 effector

SEQ ID NO: 44 - protein, 1028 aa, unidentified; identical to SEQ ID NO: 24
  REGION 1..1028: note = Description of Unknown: uncultivated organism
  REGION 1..1028: note = MG1-47 effector

SEQ ID NO: 45 - protein, 996 aa, unidentified
  REGION 1..996: note = Description of Unknown: uncultivated organism
  REGION 1..996: note = MG1-48 effector
MNKKVYAFDLGKASIGYCARDGFNILELGSLIINKDHAEVVSNRDRRRAYKTLQAHKSREEFFIKLWQDCGLPVLEKNDKRFTIEFSKEKDETLYNSTLLRITLLQEKPLEVWQIYKALHSAIQRRGYDANIRWANDSDDEKENQERVTKYTQDENGIQIITNDAYKYPCYYDAVRLGLWDEKNPLEYKKHIPLQGVTKVRTTGIVAPRSFVEKELTQLYINAQKQLPQLEKYSVNYFLYGKYGKAYATFHKQEQGKEKDYGVLGQKIPRFDNRIIAKCKLLPKRNVCNAGTIENVSFTLLMKLKNLRFTNANGERCMLDSSAIKEVYENWLKKANKDNEIKLDTTITKKEIENVIGFKIQDKIEPMKTNISGRSSFCRRACQIMNKIILEGIENPATMDVAEFTDNVDSPNGITEQEIREMLSKIGTWENLYIPDNRYEMAELSSDDRQKTDLLIGNITNPIVRNRLQILRDKLLELKAEHGTPDEVIFEFVRDGADNSLYGAKKANGYLKNIKENEKENNEIKKELEEANAYSPTNFEKLKLLRMQCGKCVYSGKNISINDFDSCEIDHVYPRTMGGNDALYNRVLCYSIENQNKAGRTPYEWLSSDKELWANYVARLNDIKGSLGKKKFELLTSKPEVCEKLIESYNGLAETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDKPFKGNTRPLETIYGYRKYGDKNYLTNRVDITSIEQKEKKIKTIVDEVIKNDLLEKLNLSSGDWAAMLKNYKHPKKHTIVKKVLTIVSEGTITTDSNNKSRMGEYADFGNKGVKNQFKHSKGHKGQILYYNEKGAVKVMPIYANQKLSEVKEKLLAMNCKLYKKGIMFYSGCLVSIPKDFKGGSNDYSAGIYTLKTIIADTGVIKLENLNGVEIGTSAKYLTDAEFRKYKN

SEQ ID NO: 46 - protein, 1015 aa, unidentified
  REGION 1..1015: note = Description of Unknown: uncultivated organism
  REGION 1..1015: note = MG1-49 effector
MKKFFAFDIGKKGLGYCCREGSKIHCAGSLTIEPDHSSVEDIRNNRKAIKTRIFHKAREEYFNKLWHDEAGLEILDKDDERFKIEFSKQDDERIYNSTLLRIALLQNRELEKWQIYKALHNAFQRRGYDSELPWKNSGTKADEENEKLAKNYTQKNGQKLIKKEKFQYPCYYDALALGMWKERNPSDLQRIVSKNPQKIRTGRRVAPRKLVIKELTDLWTAAQKQIPELQKISADKFLYGEYREPYASYTNPDWHKNMGKEKDWQGVLGQKIPRFNNRIISKCKLLPKRNVCSADTIENIVFTLLYQLKNFRYTNSNGEVGCRLAPIEIKEIYDNNIQNWMKNLYDNKKNNKSHTFTVSKTEIEKVIGKGQIYTTKNEKFKSFQANTSGRSSFCRRALQIMNEIILTGTDPKDVNISKFVDKSTTNNPITEDEIKEMLTKVGDWNELYIPYNSTRMAEFAQNPDIQSDLMIGSITNPIIRNRLQIFKNLLNDMIKKYGKPDEVIFEFVKDGKDNSLFGAEKAKATEQMMRINEKKNEEIRNNLSDDYSAINFLKYKLAEMQDWTCIYSGRKIEITDFDACEIDHIFPRTDDTNDALYNKVICYKEEIADKHGRTPYEWMNNNTARWQEYIMRVKSLSQKSGKTKTALLTLSPTQSEKFLEKRKALNETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDKPLKSALAPAGTIYGKKVKNGKTYITKRIALLDIKKDSKSINKISDNDIKSDLLNKSGKNLSDDNWVKILSKYTHPKRGTKVKKVIVLEEFKGQITFDSNGRERLGEYCDFGNKGTKGQFKHSKQHRGQILYFNEKGKIKVMPVYANKKVQDVKDELINMGCKLYHGGEMFYSGCLIEIPNDFKAGGNIQPKGIYKVSTITTAGLVKIENNSGNIVHTNSTHITEADFRKFIKRSNS

SEQ ID NO: 47 - protein, 1015 aa, unidentified; identical to SEQ ID NO: 46
  REGION 1..1015: note = Description of Unknown: uncultivated organism
  REGION 1..1015: note = MG1-50 effector

SEQ ID NO: 48 - protein, 997 aa, unidentified
  REGION 1..997: note = Description of Unknown: uncultivated organism with predicted taxonomy: Candidatus Melainabacteria bacterium
  REGION 1..997: note = MG1-51 effector
MNKKVYAFDLGKASIGYCVREDFNILELGSLIINKDHAEVITNRDRRRVYKTILAHKKREEFFNNLWSECGLTLLSKTDKRFTIEFSSSNDNTIYNSTLLRIALLQNKPLEQWQIYKALHNAIQRRGYDAEIAWTNDSADEKDNQKRVIKYTQDDLGNELIKDENYKYPCYYDALRLQLWSEKNPKDFNRHIPLTGSTKVRTTGLVVPRAFVEKELTQLYLNAQKQLPQLKKYTVEYFLYGKYGSAYATFRTPQQGKEKDYGVLGQKIPRFDNRIIGKCKLLPKRNVCKANTIENVSFVLLMKLKNLRFTDINGNKCKLGLSAIKDIYNNWYKESGNGKKLNTTITKTKIEKVIGCKILEDAKNINETLKANTSGRSSFCRRACQIMNKIILEGIANPLTMDVVEFTDDVGTANGITEQEIREMLSKIGTWENLYIPDNRYEMVELSSDDRQKTDLLIGKITNPIVRNRLQILRDKLLALKEKYGTPDKVIFEFIRDGADNSLYGAQKANNYLISIKANEKENNEIKKELEDANAYSNTNFDKLKLLRMQGGRCIYSGEKIGISNFEQCDIDHIFPRSRGGNDALYNKVLCYSKENRIKGDKVPYEWLNNTENWDIYLQRTRDLKGSLGKKKFELLTSKPDQCEKLIESYNGLADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNKPFKGNTKPLETIYGYREYNGKKYITNKIDINSLEQKEKKIKNIIDEVIKNDLLNKINLPSDEWKNMLQNYIHPKKQTHVKKVMVIVSEGDVTFDTNNRIRMGEYVDFGTKNVKKQFKHSKGHKGQILYYNEKGAIKVMPVYANQKLQEVKEKLLGMNCKLYKKGMMFTSGCLLEIPNEFYAGSNKYPAGIYKLRTIIADTCVIKIESSEGIEIVSSAKYLADAEFKKYKP

SEQ ID NO: 49 - protein, 997 aa, unidentified
  REGION 1..997: note = Description of Unknown: uncultivated organism
  REGION 1..997: note = MG1-52 effector
MNKKVYAFDLGKASIGYCAREGFNILDLGSLIINKDHAEVVSNRDRRRVHKTLLAHRTREEFFNKLWKDCGLEILDKSDKRFTIEFAKNNDSILYNSILLRIALLQNKPLEEWQIYKSLHNAIQRRGYDANLVWANDSDDEKTNKELAARYMQDEAGIELITNDEYKYPCYYDATRLGLWNEEAPNKFNRHIPLTDVTKVRTTGLVAPRQLVEKELTQLYLNAQKQLPQLNKYSVEYFLYGKYGRAYATFRKPEHGREKDYGVLGQKIPRFDNRIISKCKLLPKRNVCKAATLENVSFTLLMKLKNLRFTAPDGNKHMLSADAIREIYENWLQESNNGEKLNTTITKTKIEKVIGFKMLDDTKNINETLKANINGRSSFCRRACQIMNKIILEGIENPATMDVAEFTDDITAHNGITEAEIREMLSKIGTWDNLYIPDNRYEMAELSSDDRQKTDLIIGKITNPIVRNRLQILRDKLLELKSEYGTPDEVIFEFIRDGADNSLYGAKKSNDYLKNIKENEKENLEIKKELEDVDRYSPTNFEKLKLLRMQGGKCIYSGKPICIDDFDKCEIDHIYPRTMGGNDALYNRVLCYSIENQNKKGRTPYEWLSNDKEYWSAYVDRLNKIKGSLGKKKFELLTSKPEDCEKLIESYNGLAETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDKQFKGNIRPLETIYGYREYGNKKYITNRVDITTIEQKEKKIKTIVDEYIKKDLLDKLNLSSSEWVELMKNYKHPKKHTIVKKVLTLVSEGEISKDSNDKSRMGEYADFGTKGVANQFKHSKGHKGQILYYNEKGAIKVMPIYANQKLSDVKQKLMSMGCKLYKKGMMFTAGCLLNIPNDFYVSENLYTSGIYKLRTIMSSGQIKIENSNGKEIITSAKYLTDANFLKYKN

SEQ ID NO: 50 - protein, 1015 aa, unidentified; identical to SEQ ID NO: 46
  REGION 1..1015: note = Description of Unknown: uncultivated organism
  REGION 1..1015: note = MG1-53 effector

SEQ ID NO: 51 - protein, 1015 aa, unidentified; identical to SEQ ID NO: 46
  REGION 1..1015: note = Description of Unknown: uncultivated organism
  REGION 1..1015: note = MG1-54 effector

SEQ ID NO: 52 - protein, 1015 aa, unidentified; identical to SEQ ID NO: 46
  REGION 1..1015: note = Description of Unknown: uncultivated organism
  REGION 1..1015: note = MG1-55 effector

SEQ ID NO: 53 - protein, 1003 aa, unidentified
  REGION 1..1003: note = Description of Unknown: uncultivated organism
  REGION 1..1003: note = MG1-56 effector
MTKKVFAFDMGKASIGFCVRDNHDIKEANSIIIDKDHSDISSLRDRRRVYRTLKAHHAREAFFNTLWTECGLSLLDKNDIRFTKEFSGKKDNTIYTSCLLRIALLQNKHLERWQIYKAIFNALQRRGYDPKLAWKTAQTDDDKENLELVEKYTQENGIELIQSEEYKYPCYYDATRLGLWSEEEPNKLKTCQPMNGIIKVRSTNYVAPRSMVEKELAQLWENAQIQLPQLKKYSTDYFLYGEYREAYGSYKNPDYRKFMGTEYDWQGALGQKIPRFNNRIIAKCKLLPKRNVCKAETLENVTFVLLMKLKNLRFTSPDGQKCMLSADAIKEIYNNWLMESDNGKKLNTTITKTKIEKVIGYKMLDNTKNINDTMKVNLSGRSSFCRRACQIMNRIILDGIEEPKTMDVAEFIDNIDTPNGITEQEIRTMLSKIGTWDNLYIPDNRNEMAEIADDSRTKTDIMIGNITNPIVRNRLQIFRDLLLRLKSDYGTPDEVIFEFVRDEADNSLEGQKRAKDTENYMKAQAKENEQIKKELEEQNALSGINFEKLKLLKMQGGKCIYSGQNIGISDFDKCEIDHIYPRTMGGNDALYNRVLCYRIENQDKKGRTPYEWLSHDEEQWAAYVHRLSEIKQILGKKKFELLTSKPEDCAKIIDSYNGLAETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKKPFKGNTRPLETIYGLRYREKSYITNRVAITSIEQKDKKIKTIIDETIKNDLLNKLEEKMSSNDWINMLENYVHPKKRTHVKKVNVIVSEGKIEADKNGRDRIGEYSDFGTKGTQHQFKHSKGHKGQILYFNEKGAIKVMPVYANKSTKEVRKQLEQMGCKLYNGGELFYSGCLIEVPNEFKGTKSNQKHGIYKLRTMMSDGKVKLENNSGEEIMTSANYLVNAKFSKYKD

SEQ ID NO: 54 - protein, 1013 aa, unidentified
  REGION 1..1013: note = Description of Unknown: uncultivated organism
  REGION 1..1013: note = MG1-57 effector
MKKIFAFDMGKKGLGYCCREGSKINCAGSIIVEPDHSSIEDVRNRRRIIRTRNSHKSREKYFNKLWHVEAGLEILDNNDELFKTEFSKQNDETIYNSTLLRIALLQNRKLENWQIYKALHNAFQRRGYDSALPWKNSKTKDDEESEKQVKIYTQKDGKELIEKDEFQYPCYYDALSLGLWEEKNPYDLKRTISKEPQKIRTGGRVAPRNLVIKELSDLWIAAQKQIPKLQKISVEKFLYGDYREPYASYTNPDWRKNMGKKEDWQGVLGQKIPRFNNRVISKCKLLPKRNVCSADTIENIVFTLLYQLKNFRYTNSKGKVGCRLAPFDIKEIYDNNIEVWINNLEENKKNNKNHTFTVSKTEIEKVIGKGEIYTTKNEKFESFKANTSGRSSFCRRALQIMNEIILTGTEPQDIEVSKYVDKSTTNNPITEEEIREMLSKVGDWNELYIPDNRAEVAELAQNSDIQSDLMIGSITNPIVRNRLQIFKNLLIDMIRKYGKPEEVIFEFVRDGKDNSLFGAEKAKATEQMMKNNEKKNEEIKKNLGDDYSAINFLKYKLAEMQDWKCIYSGRKIGITDFAACEIDHIFPRTDDGNDALYNKVICYKEENADKLGRTPYEWLYHNIARWQEYVTRVKSLSQKLGKTKTALLTLPPEQSEKLLEKKNALNETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDKPLKSAVAPEETIYGKKIKDGKTYITKRISLADIKKDTKSINKISDEDIKKDLLLKSEQNLSERDWTNLLQDYIHPKRGTRVKKVITLEEFKGKITYDSNGRERLGEYCDFGNKGTKGQFKRSKQHRGQILYFDDKGKVKVMPVYSNKKVQDVKDELINMGCKLYRGGEMFNSGCQIEIPNDFKAGSNMYPKGLYKLSTITTAGQIKIENNSGNQLLTSATYLVQAEFKKSKKKR

SEQ ID NO: 55 - protein, 809 aa, unidentified
  REGION 1..809: note = Description of Unknown: uncultivated organism with predicted taxonomy: Candidatus Termititenax aidoneus
  REGION 1..809: note = MG1-58 effector
GEYEQAYGSYLNPDFKKYRGTNRDWQGVLGQKIPRFDNRIISKCKLLPKRNVCKSETIENVSFVLLMKLKNLRFTNLMGEKCILNSDAIKQIYENWKNKALKENGEYKLDTTITKKEIENVIGEKIQDKIEPMKANISGRSSFCRRACQIMNKIILEGIENPAEMDVIEFMDNIDSPNGITEKEIREMLSKIGNWDNLYIPDNRYKMAEISSDDREKTDLLIGNITNPIVRNRLQIFRDKLLKMKQEYGTPDEVIFEFVRDGADNSVLSGAKAEGYKLLCEQNYAKNEKLKNDLGDDFSPQNLIKLKLLESQNFQCIYSGNNIAPTDLDACEIDHIYPRTMGGNDALYNKVLCYSIENQNKKGRTPYEWFHQEKTEEEWIEYKNRCFNFLNKYPIPKKVKRRQDNHISKSIKEYYVKLSEYKLAKKKFELLTSKPEDCEKLIESYNGLAETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDKHFKGNTKPLETIYGYRRIDNKDYITKRISITDINKKEKVIKTILDKQIRKDLLDNLKLSDNEWKEYLSNYTHPTQKTIVKKVLTIESEGTLTFDKNNRGRIGEFADFGTKGTKYQFKHSKGHKGQILYYNEKGNIKVMPIYANQKKSDVIENLEQMNCKLYKNGMMFYSGCLIEISKEFIATVYYTIKDENDKNKQISQKETLNSGIYKLRTIKSDGTIKIENNNGIEILTSVKILSEINFKKYKKS

SEQ ID NO: 56 - protein, 1076 aa, unidentified
  REGION 1..1076: note = Description of Unknown: uncultivated organism with predicted taxonomy: Verrucomicrobia
  REGION 1..1076: note = MG1-59 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKIVVPVKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTAFAETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEKPTLEQTIYAKRLIGGKETIVKKCNVRELAYTGINPKYNYSTLVKSIKSIVAEVPKRIISDFVLSNPNLSESEWEDWCKYEALIPSKNGAPTKLLRVLCDVGSPEEYKDLSKDGCGAYRKGDSHKGQFIWKTKQGRYVVAPVYAHASKAKVFAALKNNPDCAEVCGFFRQNCLVEIPNDVVDKSGKMLLKAGVYRSNTIKTDCRAKLTNSDGISPNPISIQYLMPAGMKRIKLDTL

SEQ ID NO: 57 - protein, 956 aa, unidentified
  REGION 1..956: note = Description of Unknown: uncultivated organism with predicted taxonomy: unclassified Verrucomicrobia (miscellaneous)
  REGION 1..956: note = MG1-60 effector
EFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKEGGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 58 - protein, 1043 aa, unidentified
  REGION 1..1043: note = Description of Unknown: uncultivated organism
  REGION 1..1043: note = MG1-61 effector
MENKTVFAFDIGTGSLGTCVRKEKEILDLSVNLLPQDFASLKEAREKRRQIRTRIAHKMREKWWKEQAQKAGIEIPETGHLDEKGNFIKPDERMSREFPKEGDNTIYNSALLRIALLQGKKLEGWQIFKAIWSAIQHRGYDSNLPWINNPKRNVEEEGEENKDEKENKEAVKKYNNELKKVFGEGDENERFYYPCYYEAYKMGIWSKEEPENLNKKISNNPSPARNKDGKVDLVIPRELIEKEIKDMLIKAGDKYTYIKENLDYILYGPSKSKYAAYNLKEYKKYRGKDWEWQGLLSQKTPRFDNRLISKCVLIPRLNVCKAKDELNKEVTFLMKLNNMRYFEIKGGEEKKLNAEQIKQIFEKFKDKLKITKDQWSKYLKINFAAVPNPGQLKIDAPKISGRSSFCRPALGIIKELILSGKKPSELYKELTENNKNTDPKKGLIKEDYNFLLKLPDDYNFYISDSRDEESKLNESERKNKIDEIISEIINPVVKHRLKLFYDKLIELKQKHGTPEKIIIEFVRDPKEGFYGEKRRKEIIFEQNKKRKENDLAFEDAKKIGLKGKDAVLKIKLHKEQGGFDIYDGNPIKDNEIDNYEIDHIVPRESGGPDSYINKVLTSRKNNEEKGKRTPYEWLKDKNYWNDYVKRIKDSKTLNDKKKTLLTSSEAVNLAEKYTQLAETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEKPKLAETIYGLRKVLDNGKERYVFVMRFGKGTKIEEYYDMDLAKKNLDSILSDKIKKDFSEKLSENPSAEEWKKFIDDYNAGGKVKKIILKCSSLIDPEEIKDFLEGKVRNYGEYIKGKMPGQYLKQKKDSYGYMVYKNEEGKWIRESIYAFDSVIKKQKEIKEKYKETYYFRSGMIVEIQETFEFDGRKEKIKVKKGKYYLKTIGFTNQVKIESIDSSSDFLINLKYLMENGKMKPVF

SEQ ID NO: 59 - protein, 1043 aa, unidentified; identical to SEQ ID NO: 58
  REGION 1..1043: note = Description of Unknown: uncultivated organism with predicted taxonomy: Deltaproteobacteria
  REGION 1..1043: note = MG1-62 effector

SEQ ID NO: 60 - protein, 833 aa, unidentified
  REGION 1..833: note = Description of Unknown: uncultivated organism with predicted taxonomy: Verrucomicrobia bacterium 61-8
  REGION 1..833: note = MG1-63 effector
DGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDNAPAEERPTGNGKALKGYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRALGGPDAFWNWVLSDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFREIKQARLAGDFGRLQQLKASVFPARKRIAELYRALDKLKQPRNVRAVREWFRAQLEGASPAPNGPVLPRTMAWQRTPTEATLYRRVYLIYKDCP

SEQ ID NO: 61 - protein, 1306 aa, unidentified
  REGION 1..1306: note = Description of Unknown: uncultivated organism
  REGION 1..1306: note = MG1-64 effector
IGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNPLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAQLGRRKADLHLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFREIKQARLAGDFGRLQQLKASVFPARKRIAELYRALDKLKQPRNVRAVREWFRSQLEGASPAAKRPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYAWNPDHLAETARNILRKDDAQARTRGRRRTPAPASSPSADASPWPGFLWDREMQAKLASPKFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 62 - protein, 1150 aa, unidentified
  REGION 1..1150: note = Description of Unknown: uncultivated organism with predicted taxonomy: Verrucomicrobia
  REGION 1..1150: note = MG1-65 effector
ILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILFGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 63 - protein, 1076 aa, unidentified
  REGION 1..1076: note = Description of Unknown: uncultivated organism
  REGION 1..1076: note = MG1-66 effector
MADERIFSFDLGTGSIAYCVREGSNVIALGVDEIPSDFSELKDVRERTRQIRTRKAHKVREEWWKKHAELAGIEVPETGHLDEETGKFIPPDIRISTEFTKPGDSTIYNSYLLRIALLQGKELESWQIFKAIWSAIQHRGYERVPWINKEEDNEDTNKKRKSKSEGSEKEKEEREIQQAVVNYRNELKNAFGEKTQYYYPCYLEAYRLGIWSPDEPDNLTKTISDNPEPIRNKGGKIRRIIPRELLEAEIKQLLHQAGKKYPYIEENLDVILYGPAKTKYPAYTLKEYRRFMGKDWEWQGLLSQKTPRFDNRIIYKCRLIPRLNACKRKDPLAQEVIFLMKLKNFRYVDAETGEVLALKPEQLKTMFEEFQEEKKIGKRELEKFVKIRLNGKPHPGHTVIEPPNTNGRASFCRPALRIIKEILLTGKSPHQLYEEYTKANTNTDPRKGLVNDDYKFLLDLPAEWDKFHIPDRREEEAGLDEETRLKKIQELLGKITNAVVRHRLVLFYQKLQELKEKYGSPDKVIFEFARDPEETLDSKGRKERYKKVQDANRKAKEEAKKNLRELRNNGISIDGENALLKVRLWQEQNGRDLYTGLPIGQTEISICEIDHIIPREMGGPNAMYNFVLTKPECNREKGKRTPYQWLGSDPEKWQMFVDRINSEEYKKLSDRKKELLLKTITDEDELKELVEKYTHLAETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEKPTLAETIYGLRPYLDDNGRPTGKYVFVTRFGEGTDFEEYDDLDHAKKNVDSIYSANIRRELKQKLDENPSEQEWKIFIYNYRAGGKPKKLLMIASSDFAQEEVEKFLRGEINNLGEFIKGKMPGQYLKQSKESRGYFVYKDAKGKWRREAIYAFESPYLKKRKILSELKGRGDVYFFRSGVLVEIRNDIIKKQKPQSGNTETISKGFYYLNTIFETGYSKITSMEGKECLLSISKLMEEGKMKPAQEIRMR

SEQ ID NO: 64 - protein, 1655 aa, unidentified
  REGION 1..1655: note = Description of Unknown: uncultivated organism
  REGION 1..1655: note = MG1-67 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPAFGEKTKDGAPSDAAGANLCYTSCLLRIKLLRWKPGDPLLEEWQVYKALRSAMQKRGYGRVPWAVKEARAQGKTPEELEAEEQKQLEQADPRYREAAGKWPKFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAAFAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSELLRQNSAELERRDKAIVELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLLEAQGPACIYTNKPIRCTDLPNLQIEHIVPRSFGGPDAFWNWVLCDENANAEKGDRVPYVWFKEEKTDEEWADYKRRVLARAAQLGRRKVDLLLRPDAAELAGEKYTALAESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFREIKQARLAGDFGRLQQLKASVFPARKRIAELYRALDKLKQPRNVRAVREWFRAQLEGASPAPNGPVLPRTMAWQRTPTEATLYRRVYLIYKDCPERSLLALTDLAFAPNPRNPQQPVFDLKWLRTRIQSIAEHPGYDRKKLQSVLSAKLEATLSAKRFASCQFGPEDWQQICAQPEVAACFQPVGRGKSKRPPEPDQRLVKVCKVEVLPATRYELSELGYTSGNNYVWNPDHLAETARNILRKDDAQARTRGRRRTPAPASSPSADASPWPGFLWDREMQAKLASPEFREALEQQLVPHLLPPKPARMSDAERTDWATREERWKQAFEQFRKSHNLPKSFFVFTSDSDRPPRRPNVSLLRVLFEPKDKVFSRDALAKQAQSVVDAQLRRCLECFADSLTQVRDPRLQEKAWRDYCNVVRVVPKETLEQFTREHPTPTADQWISFFEAQTGPRIFQVMQTVGTSLEEYFDLSKDACGAFARGGNKGYWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 65 - protein, 983 aa, unidentified
  REGION 1..983: note = Description of Unknown: uncultivated organism with predicted taxonomy: Elusimicrobia bacterium HGW-Elusimicrobia-1
  REGION 1..983: note = MG1-68 effector
MGKIYAFDLGTGSLGSCVREDKEIKDLSVELLPNDFATLKEARERRRQIRTRIAHKKREEWWKEQSQKAGIEVLETGHLDKNGNFIKPDDKISRQFPESGDDAIYNSSLLRIAILQGKKLEGWQIFKAIWSAIQHRGYDSNLPWIRESKRNIDEDENTEQINKDEKENQEAVKKYNNALKDVFGDKKEYYYPCYYEAYKMGIWSPNEPNNLNKKFSANPNPARNKDGKVDLVIPRDLIEKEIKDMLLKIGESYPYIKENLDLILYGPGKSKYAAYKAKEYRKYLGKDWEWQGLLSQKTPRFDNRLISKCALIPRLNVCKAKDELNKEVVFLMKLKDVRYYKIDGGEEKYLTNEEIKNIYEKFKDKLKITERQWTKYLKENLQGSPNPSQPKIEPSKPSGRSRFCRPALRIIKEIILSGKSPDLLYKELVENNKNTDPKKGLVKEDYSFLLKMPEKWENFHIPDNRMDESKLDETERKNLIEEIFSKTSNPIVKHRLKIFYDKLIEYKNKFGEPEKVIIEFVRDTDDGFYGKIKKKKIIAEQNKNRKESDLAFKEAQTLGLKGGESILKIKLYREQGGFDLYDGKTIKDTEIDNYEIDHIVPREDGGPDSYINKVLTSRKNNDDKGKRTPYEWLSKSDNWEEYFERVKKLPKDSKKKKDLLVSANAKELVEKYTQLAETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEKPKLAETIYGLREIIDDKGNKKYVFVSRLVGDVKNIEGYYDIKTAKKYLDKIFSDKIRKDFKEKLDSNPSNEEWKSFLDNYFAGGKPKKILLKVSDEYTYDKIKDFLDGKVKNCGEFIKGRLPGQYLKQKKEAYGYFIYKNEKEKWIRDVIYAFDSVFNKMKEIKSKYKEAYFFRSEMLV

SEQ ID NO: 66 - protein, 1235 aa, unidentified
  REGION 1..1235: note = Description of Unknown: uncultivated organism with predicted taxonomy: Pedosphaera sp. Tous-C6FEB
  REGION 1..1235: note = MG1-69 effector
RAMTSPATIWAFDLGKGSLGEAVLNLETHQFHHKATLLLPADLAQRGPASQAGTPASRYRALKVRQAHRERERWLDTVWQAAGLEVLQPRQTALVCALPPKRDDTGQPLFDQGHWALVGRADYRLEREFAPALGEKTKDGAPSDAAGANLCYTSCLLRIKLLRWKPGDPALEDWQVYKALRSAMQKRGYGPVPWAAEESRPKLTKEEQAKEQEIAARWDKFKKGYRYDENPDADPNRAPLPPQFHFPCYYDAFHMGLWRPDQPDHLRPRPDHRAASTRNVRFDRADVRKELIALGNNAAAMLPQLQQAFERWQSDGWTFRHPVTGEELTKPVRARTFGEFLCDGPAGQPDETSFEAFLNQRRQAGIRIGTFEEWMAALGQKTPRFDNRILAPCVLIPRYHACKVDARLEKDRAGRLTGKLVPDSLLASEVTFLLKLKNLLVADPVKGQRKLTVEEVREIFAFAQRRLKTLPLLTPEGEPAKEWPRKVANCFAINPSDWPKIAAEAECLKGLARLTVSDNGAPRPLTREEAEALLHAVAGGRRAAQTVLPAHLLPLVKRAAAAWKQAKQQAEEIMLRPLPGHEEVKAPRTCGRSAYSRVALRILKELILSGDAPSAFHARLVRREPDLLQRLGPAPGQPLAIFDDSTASNEAQRKQENAENRKHGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEEAKRRLQTFQRQREEERKKARSIAAQAGAESALSALKCQLWEAQGGECLNGREVLDQTGQSKARCLYRQTALPLSRLDEYVIDHIVPRARGGPEAMVNYVLTTAETNEAKGDRTPFEWLHGSPDWDAYVARVKARAAALRNKKVQLLTREDAPELVERYTALAETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEPSVLADTIYGGRLDNGRPVIVQRVPVRELAYKQEQQRPVFNLTYARDQIAHVRDPRLRRVLEAFVATGPDQAAWDNYCRALAAGTCPELPDRKVLKVTLNRDEDPEEFKDLSKDGCGAFRTRKGEHRGQFVYLDARGRVRVRPVRPFESLVAVKAEVERLAAG

SEQ ID NO: 67 - protein, 1052 aa, unidentified
  REGION 1..1052: note = Description of Unknown: uncultivated organism with predicted taxonomy: Endomicrobium
  REGION 1..1052: note = MG1-70 effector
SIAYCVREGVNVLDIGVDILPGDFASLKNVREKRRMIRTRMAHKVREEWWKMHAKEAGIEVLETGHLNENGEFVKPDIRLSTEFTPPGDSTIYNSYLLRIALLQGKDLESWQIFKAIWSAIQHRGYEKAPWVRKEEAQKEPSDGKKSRKSKSEDESEKEREEKEIQQAVENYRNELKQAFGDNHQYYYPCYLEAYKLGIWSPDEPDNLTKTISENPEPIRNKDGEIRRIIPRELLEKEIKELLQQAGKKYPYIEKNLNYILYGPAGTKYPAYTLKEYRRYMGKDWEWQGLLSQKTPRFDNRIISKCRLIPRLNVCRRKDELVQDVTFLMKLKNFRFIDRETGEVKALTPEQLKEMFETFRSERKINKTELKKYVKDRLNGWVHPSHTNIDPPKTTGRASYCRPALRILKEILLTGKSPHQLYQEYTSTNTNTDPRKGLVNDDYKFLLDLPAEWDNFYIPDRREEEANLDEETRLKKIYETFSKITNSVVRHRLLLFYNKLRELKEKYGAPDKVIFEFARDPEETLETSKRKDYKKIQKFNLKAKEKAKQILEELRSKGISMQGSNKVLKVRLWQEQGGFDVYTGQPIGETEIDICEIDHIVPREMGGPNARYNMVLTKPECNREKGKRTPYQWLGQDPEEWQKFVERLEREKGFENLPAKKKNLLVATNPEELIERYTHLAETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEKPTLAETIYGLRPMLDDNGRPTGKYVFVTRFGEGTRFSDYSKLEHAKKNVDSIYSANIRRDLKNKLKENPSKEEWEVFIHNYRAGGKPKKLLMIASSEIDGDDVKKFLSGELRNLGEFIKGKMPGQFLKQAQESRGYFVYKDEKGKWRREVIYAFESPYLRRREILSKLKDCKEIYFFRSGMLVKIENDFLYEPRGGASKTIPGGYYYINTINVSEQVKITAIDGREIKLSLSQLMEKGRMKPAQKVRMD

SEQ ID NO: 68 - protein, 1110 aa, unidentified
  REGION 1..1110: note = Description of Unknown: uncultivated organism
  REGION 1..1110: note = MG1-71 effector
WQIYKALRAALQNRGQQTVPWIAREAARTGKTPEELLEEEKKAFENKDPDYQSALTKWQQFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPKIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLAETAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 69 - protein, 1005 aa, unidentified
  REGION 1..1005: note = Description of Unknown: uncultivated organism with predicted taxonomy: Deltaproteobacteria
  REGION 1..1005: note = MG1-72 effector
MPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFERWQRDGWTFRHPVTGKALTKPVHARTFGEFLCDGPAGQPDETSFEAFLNQRREAGIRIGTFEEWMAALGQKTPRFDNRILAPCVLIPRYHACKVDARLEKDRAGRLTGKLVPDSLLASEVTFLLKLKNLLVADPVKGQRKLTVQEVRDIFAFAQRRLKTLPLFTPEGEPAKEWPRKVANCFAINPSDWPKIAVETECLKGLARLTVSDNGAPRPLTREEAEALLHAVAGGRRAAQTALPAHLLPLVKRAAAAWKQAKQQAEEIMLRPLPGHEEVKAPRTSGRSAYSRVALRILKELILSGDAPSAFHARLVRRDPDLLQRLGPAPGQPLAIFDDSTASNEAQRKQHDAENRKRGLLVSELNFLLQMRKDDGSPDSWENLFIPAQTLEALQQRHTEDGRLDADAAVRELLGTIKDPVVRHRLGVFDERLRKLRFGDAREGLPGFGVPEAIVLEFVREDFMGEQAKRELQTFQKRREQARAEAEAEAAKLGLESRSSSLRYELFKAQGGICLYTGRTLSETQLDQYEIDHIVPRSLGGPDAMVNYVLTFPEVNSAKEKGKLTPYALLHGTDGWDAYVARVKARAAALRNKKVQLLTREDAPQLVERYTALAETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 70 - protein, 1141 aa, unidentified
  REGION 1..1141: note = Description of Unknown: uncultivated organism with predicted taxonomy: Pedosphaera sp. Tous-C6FEB
  REGION 1..1141: note = MG1-73 effector
SLTTLVTFPIVSPMPSPTTIWAFDLGKGSVGEAVRDIETNQFLHVAALLLPPDLARRGRADQTGTPASRYRAWKVRLAHRERERWLDTVWLAAGLTPLQKREVWRNPATGRWELKHPADYRLEREFAPALGEKTKDGAPSDAAGANLCYTSCLLRIKLLRWKRGDPPLEEWQVYKALRSAMQKRGYGRVPWAVNQARAQGKTPEELEAEEQKQLEQADPRYREAAGKWPEFKRAVPAEFHFPCYYDAFHMGLWSPDQPDQLRLRPDHRAASTRNVRFDRADVRKELIALGNNAAAMLPQLQQAFARWQRDGWTFRHPVTREALTKPVRARTFGEFLCDGPAGQPDETSFEAFLNQRREAGIRIGTFEEWMAALGQKTPRFDNRIVENCALIPRLHVCKVAPRWRRNQNGDKELDPRSLLAAEVTFLLQLKNLQVDDATAGTVRYLNTDELNEWWKHACEKAANVPLSDTWERDVLDCFKITRAEWRRWCVSKNLLPVARERSEAAALAGEIATQSAEAASGDSGAEERSRGKSQDVVQAPKPTGRSRFCRPALAILRHLLLHREKPQDFAARLRNREPALLDALDFDVLDTAPAEERPTGNGKALKRYRKQQRTWLLTGDLDFLDHVWKATDRDGNPRDFEPHQLRIPDMTLRDLRKRHDLTETPYSDLLRQNSAELERRDKAILELIGQQKNPVVRDRLTRFWQRLKHFQNPVVPSDPKKQKPGLGLADPACLVLEFVRDDKDNSLEGRKRTEAIQQALRENEQRRDKARKALEQCGLPTTDDMVVRWLLREAQGGVCIYTSNEIRPADLPNLQIEHIVPRSRGGPDAFWNWVLCDENANAEKGDRVPYVWFKEEKTDEEWADYKRRVLARAAHLGRRKVDLLLRPDAAELAGEKYTALAESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFREIKQARLAGDFGRLQQLKASVFPARKRIAELYRALDKLKQPRNVRAVREWFRAQLEGASPAPNGP

SEQ ID NO: 71 - protein, 1171 aa, unidentified
  REGION 1..1171: note = Description of Unknown: uncultivated organism
  REGION 1..1171: note = MG1-74 effector
WIPKLCQKADYRLEREFPPSRILPSGKAKDGAPAATEADLAICYNSALLRIKLLRGEKLEEWQIFKALRAALQNRGQQIVPWIAREAARTGKTPEELLEEEKKALKDKDPDDQSPMTKWQEFCQLDPIKNNHSLQYPCYYDAYKIGLWDPTQPNSFKNKPDHNAASTQQVVFPGDRIEAELLLLAQNAATQLPVLDHAYKKVIGEFLNDRRARIENINQKRAARAQARNQAPRLLSTENLPHAKNFAELFVYGPAGKPNLPNGYRNIALADASIARALVLRPGTDFDHQSAIGQKIPRFDNRILAHCALFPRFHVCKATPRIYPDNSVDADSLLPCEVTFLFKLKNLRVSRAGQVTSLTPQQIQTIFHHVRNTALSQLGAAQEPSAKALASKFSLTKTELTKWGKKPGMAFSLLPTQQEIEKPKFLGRSRFSKPALKIIKEIILSGKSPQQIAQELKAPNSPLAQQLQLKISPQSPMQGLTHHDLDILTKCGDSWDNFHIPDTTTDFLLSTNQNSSYPNQSDKDTLIKKYIATSNNPIIRHRLELFYERLRLHLEKYGKPDFIALEFVREDFLGEEAKKKIQKIQNENKKLNSQAAEKVEELKLAGRQSILKYKLWQLQGGICLYTGKPIAQTEIESHEVEHIVPRNHPQTQGPDAQWNLVLTAREINDRKANRTPFEWFQQDPIAFQWPMGQPDASIPSQEKQRLWEAYCDRIKQRKKNLGNKRVKLLLSDKAPELVERYETLATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEKARLADTAYGFRIINNKKKIAQRVAVEKLAYPGQEQKFDLAYLEGQIPSIADEKIRSMLTEIYNNIKSKTLQEAEQTWKDECAKLRLKTRDGSPGPFIKKVTQITDFHREYKDLSKDGTGAYYKGGDRHQGQFIYRDARGEFTVHPVYVHESIPQVKKALIEQNKTICIFVNSGCLVKTAQPIDPANYRKIIYENNKPKRITPEHPLPSGIYKWRTIIESSTSVTLENVFGEEFAINFCHLCKAGIQRL

SEQ ID NO: 72 - protein, 800 aa, unidentified
  REGION 1..800: note = Description of Unknown: uncultivated organism
  REGION 1..800: note = MG1-75 effector
MTESDPFQHKAILRKWENHEFYRSSVVLGLDVGLEGIGVYLRKGPRTLYEKTLLYQIPKTNALQDRRQSRAARRCRKNRRTRMTRLKALFERHGFPWFEGNDDALTRSDPFLLRHRATTKKLASREALGICIRHLVTHRRYEFFSDEGENPWGEEASLATEVKWLRTAYVDEKDADLLRTECRVLADVAGGRAEDKYEEFRQILEDRIVTERNNPILEMLESYAGEKRNHLRQKARGAVFPRRLVWSHLESICRRHGELFDDVDEFLRDLGAPRSRKDRAIFNYHRKTEEEMKAHWARKVGPCPYAEMLGLSSKLRRGVRGEMPIRRFSLLEFLVSRRIELSDGRLLLVPDSCIEMLFDWMERFEAAYRDQRTLPPMKKIREIVVGEMRKSTGQAPAPASKSEINKAFFEQIKGIMAPTASRRNARASLSCEAAEKLFEEATSSGLSRDSVNRQLQTYYQWRKRASSDFGLYPQVEFLLGRRRRRRAGEGEYAVSGRLQRIFSLPEVVEHLDGQASPDYCVIEVVGDIPRNEKERREKEQEIRKNQGRKEKLFERFNAADSAVGSAYKRVLLFDQQRGLCPYSGGELGDPLSSDLEIDHIFPRKRGGISVRENLVLTFADRNRDKGNLTPREAARKRNGWDWDEIEAATARMKWSRKKREIFEREGAGIPPLANVTRTAQLARQLVAECAHWMGIAGDPDEIQRRIGTPSGYMRAQALRSWEDTVPAKNRSDLVHHLVDAAVVAHIPPGAGMNQVSYGGIFYPSSVDGKDRARLAALPLGPGLRRWTAAEPLECSAAPPG

SEQ ID NO: 73 - protein, 953 aa, unidentified
  REGION 1..953: note = Description of Unknown: uncultivated organism
  REGION 1..953: note = MG1-76 effector
MGNGTIFSFDLGTGSIATCVRQDEEIKYIHVETLPGEFATLKETRERRRQIRTRLAHKQREEWWKIHAKEAGIEVLETGHLDEKGNFISPDPRLTCEFSKKGNPTIYNSLLLRIALLQGKKLEGWQIFKAIWNAIQRRGYDENIPWKHKLEAEKTEDDNEQENSKQTKGKKSKKKEDANSEDEEQKIRQAVIKYKEKLNNTFGDKEEYKYPSYLEAYLLGIWSPDEPDNLTKTISENPEPIRNKDGNIKLITPTELVEKELKQLLVKVGEQNEYIKKNLNYILYGPSGCRYGTYILPKYRRYIGKDREWEGLLSQKTPRFDNRIVYKCRLMPRFNVCKRKDLLSQEVIFLMKLKNFRFVDAETGEEKMLTPEQIQKMFNDFQNTLKINNRELKKYLKENFKGEIHPSFPAIDAPNTKGRASFCRPTLKIIKEIILSGKSPHTLYQEYTSSNTNTDPKKGLINNDYKFLLKMPTEWENFHIPDEREDEAQLNEDERIKVIYNILSKITNPVVRHRLLLFYRKLQYLKQEFGIPNIVMLEFARDPEELLAGEERKKKYLKLQKENRQKKEKAEKIYQELKNGNVNLKGRSILLKIQLWQEQNGIDPYSGEQIPQTKINLYEIDHIVPREMGGSDAYFNKVLTSPEKNREKAKRTPYQMFKGNISDWKKYLNTIEKITNLSKKKRALLTSENPEELIERYTHLAETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVKAKLAETIYGLRERNDYTEEEKKKGKKQYVFVTRFGTGTTLKELKEYDDLKFAKKNVESIYSYNIRQDLMKKLEEKPAPEEWKVFLHNYRAGGKPKKILVKASSYIDEEEVQKFLNGEIPNLGE

SEQ ID NO: 74 - protein, 898 aa, unidentified
  REGION 1..898: note = Description of Unknown: uncultivated organism
  REGION 1..898: note = MG1-77 effector
MTTPATIWAFDLGKGSLGEAVRDQQTNQFLHKATLLLPADLAQRGPATQAGTPASRYRALKVRQAHRERERWLDTVWQAAGLEVLQPRQTALVCELPPKRDDTGQPLFDQGHWALVGRADYRLEREFAPALGEKTRDGAPSDAAGANLCYTSCLLRIKLLRWKPGDPPLEEWQVYKALRSALQKRGYGRVPWAVKEARARGKTPEELEAEEQKQLEQADPRYREAAGKWPEFKRAVPVEFHFPCYYDAFHMGLWSPDQPDHLRLRPDHRAASTRNVRFDRADVRKELIALGNHAAAMLPQLQQAFERWQRDGWKFPHPVTGQELTKPVRARSFGEFLCDGPAGQPDETSFEAFLNQRREAGIRIGTFEEWMAALGQKTPKFDNRILAPCVLIPRYHACKVDARLEKDRAGRLTGRLVSDSLLASEVTLLLKLKNLLVADADTGQRKLTVEEVRDIFAFVQRRLKLLPLLTPEGEPVKEWPRKVADCFAINPSDWPKLAAETECLKGLARLTVSDNGAPRPLTREETEVLLHAVAGGRRAAQTALPAHLLPLVKKAEAAWKQAKQAVEGNILRPLPGHEEVKAPRTSGRSAYSRVALRILKELILSGDAPSAFHARLVQREPDLLQRLGPAPDQPLAIFDDSTASNETQRKQEDAENRKRGLLVSELNFLLQMRKDDGSPDSWENLFIPAQTIEALQQRHTEDGWLDADAAVRELLGTIKDPVVRHRLGVFDERLRKLRFGDARERLSGFGVPEAIVLEFVREDFMGEQAKRDLQSFQKRREQARAEAEAEAAKLGLGSRSRALRYELFKAQGGICLYTGRPLSETQLDQYEIDHIVPRSLGGPDAMVNYVLTFPEVNSAKEKGKLTPYALLHGTPHWDAYVARVKARAATLRNKKVQL

SEQ ID NO: 75 - protein, 1035 aa, unidentified
  REGION 1..1035: note = Description of Unknown: uncultivated organism with predicted taxonomy: Verrucomicrobia
  REGION 1..1035: note = MG1-78 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRTPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 76 - protein, 1333 aa, unidentified
  REGION 1..1333: note = Description of Unknown: uncultivated organism
  REGION 1..1333: note = MG1-79 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNCTIEFQMAEFAEPKLVKGQIPDPATERLLETYELTCSNEADLLWLLEVTTGKRIKLPPPVVENAPTTGKREGELL

SEQ ID NO: 77 - protein, 1035 aa, unidentified
  REGION 1..1035: note = Description of Unknown: uncultivated organism with predicted taxonomy: Verrucomicrobia
  REGION 1..1035: note = MG1-80 effector
MSKTETVWAFDLGKGSMGEAVRQGNQFLHKASLLIPAEFAETRTARDRRRMWRTRQAHKARERWLDEVMTAAGIEVLKGRQVGKVDGKWVETAKGDPRLEREFAAPGDSTCYTSCLLRIKLLRGEKLEPWQIYKALHSAIQRRGYDPDIPWKTREQRQGKKSEDEEGKTLTRMQEFEKQLLAMSPDHPEYRWPCYFDAWKMGLWSPAKPDELKERLDFNAQTTRDQIVPRKVVEAEVRALVEAASQFYPSLKGKADYLLYGPPQRAYASYYVEQRKQHGLREGGVNDWQGVVGQKIPRFDNRIIGKCVLIPRLNVCKIRKGDDGKLHPQSRIVAETVFLMKLKNMRLQTAKGVTGLTAQQISKIFADPKRKKYGLTKTQWKQWCIKFGGMPLPGNQEEVEEPHFGGRSRFCRPALEIVKRLILSGDTPPMAYEKEVARLNGNTDPLKGLVKDDLKFLLQMGPTWEGIYIPNQKLDALTRSTEDANEAIRQLIGAQNDPIVRHRLTLFADRLNLLAEKHGTPDCVVLEFVREDFMGRKAKQEYLKFQRERAKERSEAREEAAKAGATEGAAGLKMELYKAQGGICLYTGEALSVTSLDEYVIDHIVPRAKGGPDSVMNYVLTTRRANDDKLDRMPYEWLSQTPGWDAYVERVKERAVTLRNKKVSLLTRPDADTLVDKYTALAETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEKPALAETIYGARNDHGAKVIVQRTALLSLAMKPTTPGKTTFDLKYAGKQAQSVRDPIIQKRLLEFIATNPDEATWRKFCAELHIKRKDGTAGPRVEYVTVTVGEPTEYKDMSKDGTGAYRKALKGHKGQFVFVDSKGKFKVRPVYAFESAQKVGQELTQKFGQNAIKGFFQSGCLVELTAPVPHSFTPLVPGQYKLNTIFTDGRAKLTDSTGKQSLPISLEKLFSAGFKRAR

SEQ ID NO: 78 - protein, 1074 aa, unidentified
  REGION 1..1074: note = Description of Unknown: uncultivated organism
  REGION 1..1074: note = MG1-81 effector
MNSSRSPVTRFSTGLVFGFDVGTGSIGWAVRNGTEFLDVGVLVCPEETAKLDSRRGLRRQRRTLRSKKYRRQWFARELAGLLGLTLIRQGQSELPLPETAWEQNAKGGWVPKPGFESLRDPVALRVAAAEGEPLRPEELFTALVHLFRLRGYLADVPWANREVEAKESDAKKEEGEIRARMSALQAEMQAAGCELPCQLLALRANNGQRQRKEVWPRELVEKEFRAIVAAQATRHPTLAEKADWLLFGDCREVKSHRVFFKTTESRNPGVLGLKWPRFDNRGPALDALRPIDELGRPLHVVRKNKEAFSKAQWELAVMNFRVIDRQTGALVPPDARALARLREMWESSSRKRRAKKEAMSGTPAGSPETTPRVEIKVALLEKWAAEFANRYKLVEGQQSLTPQTGAGRARYSTPTLELIREQFERGIRFDPPQPVLRRPGESPQRALDRYLADIKHPLVRHRLLLFSRLLDKLVKQHGEPDLIVLEAVRSLALGEKNKRELLKRNKANRDQRESIRQELASRNASTSRNAILRYRLWKEALSTCPFCGDKITQEQLLRGEADIEHLVPRSVVDCNEFYNLTVGHVRCNRELKGDRTPFQAFGHTEKWPQLRDNAEKCFKGRKLEIFLSDNAEQLIEQKADLQHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQSAYATTIYGKKAPNTYVAREVFTTLTPKNLGSIWPPDFAAYCEAAWARYVEESPDIEAELKRSKGCVPESFTARLCFAHFQQWRELMKRGENVEFTWPETVKIPIRSVRLISVKDDTAVMRFAPGTPGYVKRTGFKEVRIHVSADGNSFVPVFVPYWKGDAIPPETPIKTGTRPVAVIRKGQVVGLKKPLAAGASAGHYRVIVLGQSQVSILPPHVANKDEAKLALGIPRTGIKPYWPEFIRALGYELPHPPSAQSPPPGALPT

SEQ ID NO: 79 - protein, 917 aa, unidentified
  REGION 1..917: note = Description of Unknown: uncultivated organism
  REGION 1..917: note = MG1-82 effector
MTPATTIWAFDLGKGSLGEAVRDLQTDQFLHTTTLLLPADLAQRGPARQAGTPASRYRAWKVRHAHRERERWLATVWRATGLTPLQTREVWQNPSTGRWELKHPADYRLEREFAPTLGEKTRDGAPSDEAGANLCYTSCLLRIKLLRWKPGDPPLEKWQVYKALRSAMQKRGYGRVPWAVKEARARGKTPEELEAEEQKQLEQADPRYREAAGKWPDFKRAVPAEFHFPCYYDALYMGLWSPDQPGHLRLRPDHRAASTRNVRFDRADVRKELIALGNNAAAMLPQLQQAFERWQHDGWKFLHPVTGQEVTYPVRARTFGEFLCDGPAGQPDETSFEAFLNQRREGGIRIGTFEEWMAALGQKTPKFDNRILAPCVLIPRYHACKVDARLEKDRAGRLTGKLVPDSLLASEVTLLLKLKNLLVADADKGQRKLTVEEIRDIFAFAQRRLRTLPLLNPKGEPVKEWPKKVANCFAITPSDWPKLAAETECLKGLARLTVSDNGTSRPLTSEEAEALLHAVAGGRRAAQTALPAHLLPLLKRAADTWRQAKQAAEGNVLRPLPGHEEVNAPRTSGRSAYSRVALRILKELILSGDAPSAFHARLVRREPVLLQRLGPAPDKPLAIFDDSTASNEAQRKQADAENRKRGLLVSELSFLRQMRKDDGSPDSWENLFIPAQTLEALQQRHTENGRLDADAAVRELLGTIKDPVVRHRLGVFDERLRKLRFGDAREGLPGFGVPEAIVLEFVREDFMGEEAKRRLRSFQRQREAERKRAREETAEAGATEKSAPLKYELLTAQGGLCLYCGQALTLKKLEQYAIDHIVPVGAQGSDALFNKVLAHQECNAAKGKQTPFEWLHGTPGWDAYVARVKARAATLRNKKVQLLTREDAPELVERYTALAETAWISKLAQTIVNLRFG

SEQ ID NO: 80 - protein, 1016 aa, unidentified
  REGION 1..1016: note = Description of Unknown: uncultivated organism
  REGION 1..1016: note = MG1-83 effector
DSAGKPQQTILDYHRKTPEEAKELWERKVKDCPFAPTLHQQDKLSTPKHKCSFRSDARIRRFNLLMFLAERRVELETEDAQGQRQNPCVNLDAEVVRQLMEDLEKDIHAVEALVNKQPAPRPDKPGKKNFEKRFNLSLAGVAKGSFNADFFDQLGDLLRPELRSLRQRASLSGEAAEVLYQLATNNGTTFEPVKVRQALEECDYYHWRANPPHGLGIYPQVAFLLGQRGHYDDEGNPTDKDKAGNPVHHGILRRLFAGQLRLDDGTGQGAKLIDLCEHLDGKTVPDYVIIETIGDIPRNQKEKKEFKDEIKANRSRKTDIIEKKYNLKLDSLSDWQVKQVLLFDQQANDDGEAFSPYTGASLGKNPLAHGLEVEHIYPERRGGISIMDNLVITWRTENQTKGDQTPWEWLGQRATAQLQKMHWNRDKRALFVREESEPPQWDNTTRMAQIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRKSKRSRYKDTIFGLPDREQKHFAREPLDKVVAGLLKSKKKNPDVQLRKLLDRPGFLKPLEIKNKKTGEMKRIQLLREEDLTRWLSCKDISLDPQEFRDFIAKLGVPAECVTDEAVAEQFLNSKTGESRPKWNFKPTQIIAFIRKCGVKEDKLPNSRVEDAIRARKECTVLRASNGRDGQQGQAIRRIPIEQDKLPPCGFGLHFNPTAEAKHGNAIAGFKAVDNSNSIVYLRREIWIGQKWKKKGKDKVASTFYESRLIPHPRHLAAYEKLHGQPWKSEPLPAGMSLAGCLAVGDLLRVPLKKEKKNAGDNLIAKRGEPPVEWKFYRVKSLRTEGPVEFQLAEFTEPKLAKDQIPDAATKRLLDICELSSRKDADLLWLLEATTGQEVQPLPPCDEPPPVSPTKPATKTGDELL

SEQ ID NO: 81 - protein, 1062 aa, unidentified
  REGION 1..1062: note = Description of Unknown: uncultivated organism with predicted taxonomy: Coraliomargarita sp. CAG:312
  REGION 1..1062: note = MG1-84 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 82 - protein, 1080 aa, unidentified
  REGION 1..1080: note = Description of Unknown: uncultivated organism with predicted taxonomy: unclassified Verrucomicrobia (miscellaneous)
  REGION 1..1080: note = MG1-85 effector
YIVDFCSHCKYFNNNKKFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 83 - protein, 1062 aa, unidentified
  REGION 1..1062: note = Description of Unknown: uncultivated organism with predicted taxonomy: Coraliomargarita sp. CAG:312
  REGION 1..1062: note = MG1-86 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLQFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDMETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPVLEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 84 - protein, 1073 aa, unidentified
  REGION 1..1073: note = Description of Unknown: uncultivated organism with predicted taxonomy: Verrucomicrobia
  REGION 1..1073: note = MG1-87 effector
MYTKEIIWGFDIGKGSLGEAVRVGNEFKHVQSLEIAPDFAETKTTAAARRAWRTREAHKAREFWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELVKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLASLKNNPDCAEVCGFFRQNCLVEIPNDVVDKSGKMLLKSGIYKSNSIRADGYGYLENSDGISSKPISIQYLMPAGMKRIKLDII

SEQ ID NO: 85 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-88 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 86 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-89 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCCNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 87 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-90 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGIFNSHCTVDVGDVYNDKGDFILPAGRYMVNTIRSDNQCVLTNADGEKRNPININYLMRAGMRRVDLSEL

SEQ ID NO: 88 - protein, 874 aa, unidentified
  REGION 1..874: note = Description of Unknown: uncultivated organism
  REGION 1..874: note = MG1-91 effector
MVKRVARLRQTFWRDTENPDVVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 89 - protein, 1077 aa, unidentified
  REGION 1..1077: note = Description of Unknown: uncultivated organism with predicted taxonomy: unclassified Verrucomicrobia (miscellaneous)
  REGION 1..1077: note = MG1-92 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 90 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-93 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 91 - protein, 762 aa, unidentified
  REGION 1..762: note = Description of Unknown: uncultivated organism with predicted taxonomy: unclassified Verrucomicrobia (miscellaneous)
  REGION 1..762: note = MG1-94 effector
NRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRASYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGDRTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKFLLKAGFYKSNTIMASGSVKLTDPNGIIKIVGIQHLMNAGMKRVETNTI

SEQ ID NO: 92 - protein, 1062 aa, unidentified
  REGION 1..1062: note = Description of Unknown: uncultivated organism with predicted taxonomy: Coraliomargarita sp. CAG:312
  REGION 1..1062: note = MG1-95 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARATELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 93 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-96 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANVAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 94 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-97 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGIVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 95 - protein, 1059 aa, unidentified; identical to SEQ ID NO: 86
  REGION 1..1059: note = Description of Unknown: uncultivated organism with predicted taxonomy: unclassified Verrucomicrobia (miscellaneous)
  REGION 1..1059: note = MG1-98 effector

SEQ ID NO: 96 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-99 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 97 - protein, 1062 aa, unidentified
  REGION 1..1062: note = Description of Unknown: uncultivated organism with predicted taxonomy: Coraliomargarita sp. CAG:312
  REGION 1..1062: note = MG1-100 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINSTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRVSIKYK

SEQ ID NO: 98 - protein, 1055 aa, unidentified
  REGION 1..1055: note = Description of Unknown: uncultivated organism with predicted taxonomy: unclassified Verrucomicrobia (miscellaneous)
  REGION 1..1055: note = MG1-101 effector
MENRVNIWGFDIGKGSLGEAVRIGSEIKHVQSLILYKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVVFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIRSLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRESTNKEKADMTPYEWLSRNADRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQKPRLEQTLYSKRVVGGKECIVRKFNLIDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQIVWRSTNGKCYVMPIYVHASKYGLIEALKKRADFKEIVGLFRMHCLVNIERDVVNKNGQKLLPPGIYMLNTIMTKGTAVLTNTDGVKQKEVNMNYLVESGMRPIKVDY

SEQ ID NO: 99 - protein, 1012 aa, unidentified
  REGION 1..1012: note = Description of Unknown: uncultivated organism with predicted taxonomy: unclassified Verrucomicrobia (miscellaneous)
  REGION 1..1012: note = MG1-102 effector
ALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 100 - protein, 1059 aa, unidentified
  REGION 1..1059: note = Description of Unknown: uncultivated organism with predicted taxonomy: Verrucomicrobia
  REGION 1..1059: note = MG1-103 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVKRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 101 - protein, 1062 aa, unidentified; identical to SEQ ID NO: 81
  REGION 1..1062: note = Description of Unknown: uncultivated organism with predicted taxonomy: Verrucomicrobia
  REGION 1..1062: note = MG1-104 effector

SEQ ID NO: 102 - protein, 1059 aa, unidentified
  REGION 1..1059: note = Description of Unknown: uncultivated organism
  REGION 1..1059: note = MG1-105 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 103 - protein, 1073 aa, unidentified
  REGION 1..1073: note = Description of Unknown: uncultivated organism with predicted taxonomy: Verrucomicrobia
  REGION 1..1073: note = MG1-106 effector
MYTKEIIWGFDIGKGSLGEAVRVGNEFKHVQSLEIASDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENVANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWLSSKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAHASKAKVFAALKSNPDCAEVCGFFRQNCLVEISNDVIDKSGKMLLKAGVYRSNSVRSNGQVAITNSDGISPNPISIQYLMPAGMKRIKLDTV

SEQ ID NO: 104 - protein, 1073 aa, unidentified; identical to SEQ ID NO: 84
  REGION 1..1073: note = Description of Unknown: uncultivated organism with predicted taxonomy: Verrucomicrobia
  REGION 1..1073: note = MG1-107 effector

SEQ ID NO: 105 - protein, 1073 aa, unidentified
  REGION 1..1073: note = Description of Unknown: uncultivated organism with predicted taxonomy: Verrucomicrobia
  REGION 1..1073: note = MG1-108 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAELQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 106 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-109 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRSAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 107 - protein, 1073 aa, unidentified
  REGION 1..1073: note = Description of Unknown: uncultivated organism with predicted taxonomy: Verrucomicrobia
  REGION 1..1073: note = MG1-110 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKDKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREEQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGKALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHNGQFIWKTKQGRYVVAPVYAHASKAKVLAALKNNPDCAEVCGFFRQNCLVEIPNDVVDKSGKMLLKSGIYKSNTIMSDGRAKFTNSDGISTNPISIQYLMPAGMKRIKLDTV

SEQ ID NO: 108 - protein, 1062 aa, unidentified; identical to SEQ ID NO: 97
  REGION 1..1062: note = Description of Unknown: uncultivated organism with predicted taxonomy: Coraliomargarita sp. CAG:312
  REGION 1..1062: note = MG1-111 effector

SEQ ID NO: 109 - protein, 1059 aa, unidentified; identical to SEQ ID NO: 96
  REGION 1..1059: note = Description of Unknown: uncultivated organism with predicted taxonomy: unclassified Verrucomicrobia (miscellaneous)
  REGION 1..1059: note = MG1-112 effector

SEQ ID NO: 110 - protein, 1034 aa, unidentified
  REGION 1..1034: note = Description of Unknown: uncultivated organism with predicted taxonomy: Verrucomicrobia
  REGION 1..1034: note = MG1-113 effector
MGAEFRHVASLLLDKDFGEIKTAAGLRRQMRTRKAHKAREKWLERCLSDFGIEPLKRREVGIVNGRWMLISKGDERLEREFPPDGEDICYNAIALRCKLLLGEKLESWQIFKALNSAIQNRGYDENIPWKESDVSPSKKDDDDYAKRLSQYSREKSELLESFEGGEKYDYPCFFKAYKMGLWSPENPERVEIRIGNDAQKAKGYVIPRKDVEREFESLVEAASKWHPAMKGKAMYMMYGIAETPYASFKPSLRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRAAFSRPAMLLLKELIFSGMPPAEFYAKKAGEISNADPNKGIVASDLDFIKLMGNCGWNGIFIPDVETYRFANDGADSAKLINGLIGSQNNPIVRHRLAFFYERIKFLESKFGIPDKVVLEFVREDFMGKEQKKRMQIGMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRIKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKKPRLEDGIYSMRAVGGKKFMARRVNLVDLAYTVGQKPVYDISVLIGKKNPKEKKIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNPNGEKSNLININYLMKAGMRKVSVKDL

SEQ ID NO: 111 - protein, 1077 aa, unidentified
  REGION 1..1077: note = Description of Unknown: uncultivated organism with predicted taxonomy: unclassified Verrucomicrobia (miscellaneous)
  REGION 1..1077: note = MG1-114 effector
MSLYFIEQISDWKIMKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 112 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-115 effector
MKVIEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 113 - protein, 1073 aa, unidentified
  REGION 1..1073: note = Description of Unknown: uncultivated organism with predicted taxonomy: Verrucomicrobia
  REGION 1..1073: note = MG1-116 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLYNPDLKESEWEDWCKYEAAIPSKNGAPTKLLRVLCEVGSPEEYKDLSKDGCGAYRKGDSHKGQFIWKTQKGKYMVAPVYAHASKAKVFASLKNNPDCAEVCGFFRQNCLVEIPNDVIDKSGKMLLKAGVYRSNSVRSNGQVAITNSDGISPNPISIQYLMPAGMKRIKLDTV

SEQ ID NO: 114 - protein, 1062 aa, unidentified
  REGION 1..1062: note = Description of Unknown: uncultivated organism with predicted taxonomy: Coraliomargarita sp. CAG:312
  REGION 1..1062: note = MG1-117 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 115 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-118 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDGYAEIEPPKESGRASFSRPAMEILKELIFSGMPPREFYGRKISEISNTDKNKGVVSSDLDFIKLMGDCPWGGIFIPDVQTYLFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 116 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-119 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKLGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 117 - protein, 1034 aa, unidentified
  REGION 1..1034: note = Description of Unknown: uncultivated organism with predicted taxonomy: unclassified Verrucomicrobia (miscellaneous)
  REGION 1..1034: note = MG1-120 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 118 - protein, 1057 aa, unidentified
  REGION 1..1057: note = Description of Unknown: uncultivated organism with predicted taxonomy: unclassified Verrucomicrobia (miscellaneous)
  REGION 1..1057: note = MG1-121 effector
KEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISAIALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIWKSGPCVLTNADGEKRNPININYLMRAGMRRVDLSEL

SEQ ID NO: 119 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-122 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSKTPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 120 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-123 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 121 - protein, 1073 aa, unidentified
  REGION 1..1073: note = Description of Unknown: uncultivated organism with predicted taxonomy: Verrucomicrobia
  REGION 1..1073: note = MG1-124 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 122 - protein, 1062 aa, unidentified
  REGION 1..1062: note = Description of Unknown: uncultivated organism with predicted taxonomy: Verrucomicrobia
  REGION 1..1062: note = MG1-125 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 123 - protein, 1054 aa, unidentified
  REGION 1..1054: note = Description of Unknown: uncultivated organism with predicted taxonomy: unclassified Verrucomicrobia (miscellaneous)
  REGION 1..1054: note = MG1-126 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLVKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 124 - protein, 1073 aa, unidentified; identical to SEQ ID NO: 103
  REGION 1..1073: note = Description of Unknown: uncultivated organism with predicted taxonomy: Verrucomicrobia
  REGION 1..1073: note = MG1-127 effector

SEQ ID NO: 125 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-128 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLQSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 126 - protein, 1073 aa, unidentified
  REGION 1..1073: note = Description of Unknown: uncultivated organism with predicted taxonomy: Verrucomicrobia
  REGION 1..1073: note = MG1-129 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRIIDKCKLIPRLNVCRIKPLDKCKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDIGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 127 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-130 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKPELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPNESAWRKWCEEVRLPSKSGLGARVMRVLVYYGEADEYKDLSKDGCGAYRKGDEHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 128 - protein, 1077 aa, unidentified; identical to SEQ ID NO: 89
  REGION 1..1077: note = Description of Unknown: uncultivated organism with predicted taxonomy: unclassified Verrucomicrobia (miscellaneous)
  REGION 1..1077: note = MG1-131 effector

SEQ ID NO: 129 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-132 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 130 - protein, 1062 aa, unidentified
  REGION 1..1062: note = Description of Unknown: uncultivated organism with predicted taxonomy: Coraliomargarita sp. CAG:312
  REGION 1..1062: note = MG1-133 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRLKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRISIKYK

SEQ ID NO: 131 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-134 effector
MKVMEDEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 132 - protein, 1058 aa, unidentified
  REGION 1..1058: note = Description of Unknown: uncultivated organism with predicted taxonomy: unclassified Verrucomicrobia (miscellaneous)
  REGION 1..1058: note = MG1-135 effector
MEKEKNNHVWGFDIGKGSLGEAVRIGGDFKHIASVLLDPEFGEIKTAALVRRQMRTRKAHKAREKGLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 133 - protein, 1073 aa, unidentified
  REGION 1..1073: note = Description of Unknown: uncultivated organism with predicted taxonomy: Verrucomicrobia
  REGION 1..1073: note = MG1-136 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVMPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASAAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKKSALEQTIYALRKGRIVKKCNVRDLAYTGINPKYNYSTLVKSIKSIVGEVPKRIVSDFVLSNSDLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 134 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-137 effector
MEKEKNNHVWGFDIGKGSLGEAVRIGGDFKHIASVLLDSEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKIGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 135 - protein, 1059 aa, unidentified; identical to SEQ ID NO: 86
  REGION 1..1059: note = Description of Unknown: uncultivated organism with predicted taxonomy: unclassified Verrucomicrobia (miscellaneous)
  REGION 1..1059: note = MG1-138 effector

SEQ ID NO: 136 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-139 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 137 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-140 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNMGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 138 - protein, 1073 aa, unidentified
  REGION 1..1073: note = Description of Unknown: uncultivated organism with predicted taxonomy: Verrucomicrobia
  REGION 1..1073: note = MG1-141 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 139 - protein, 1060 aa, unidentified
  REGION 1..1060: note = Description of Unknown: uncultivated organism with predicted taxonomy: unclassified Verrucomicrobia (miscellaneous)
  REGION 1..1060: note = MG1-142 effector
MKVMEGEGGNHIWGFDIGKGSLGEAVLDGSEFKHVASLLLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYENIPWNESDASPSKKEDGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELFEKQGGVCLYTGEPLLPSELGILEIEHIVPRSRGGPDAQYNYVLTREKTNKEKADRTPFEWLSSDPVRWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRMVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGCGAFRRGDGHKGQIVWESTDGKYYVLPIYVHASKAKLLAELCANPKKKRICGIFTSHCMVKVGNTYNNKGELLLPEGVYMVNTIRTDGWIQLTSANGDKSKPININYLMKAGMKKVLVKDL

SEQ ID NO: 140 - protein, 905 aa, unidentified
  REGION 1..905: note = Description of Unknown: uncultivated organism with predicted taxonomy: Verrucomicrobia bacterium
  REGION 1..905: note = MG1-143 effector
KESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLMKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLSEGVYMVNTIRTDGWIQLTSANGDKSKPININYLMKAGMRKVSVKDL

SEQ ID NO: 141 - protein, 1025 aa, unidentified
  REGION 1..1025: note = Description of Unknown: uncultivated organism with predicted taxonomy: unclassified Verrucomicrobia (miscellaneous)
  REGION 1..1025: note = MG1-144 effector
LLDADFGEIKTAAGLRRQMRTRKAHKAREKWLESCLSGFGMETLKRREVGIVNGQWTLISKGDERLEREFPPDGENICYNSIALRCKLLLGEKLEGWQIFKALNSAIQNRGYDENIPWKESDASPSKKEDGDYAQKLSQYSKEKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSEIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGLVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 142 - protein, 1073 aa, unidentified
  REGION 1..1073: note = Description of Unknown: uncultivated organism with predicted taxonomy: Verrucomicrobia
  REGION 1..1073: note = MG1-145 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKLFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEKSKLEQTIYSLRKGRIVKKCNVRDLAYTGINPKYNYSTLVKSIKSIVGEVPKRIVSDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKAGVYRSNSVKSNGQVAITNSDGISPNPISIQYLMPAGMKRIKLDTV

SEQ ID NO: 143 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-147 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAIEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGVRVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 144 - protein, 938 aa, unidentified
  REGION 1..938: note = Description of Unknown: uncultivated organism with predicted taxonomy: unclassified Verrucomicrobia (miscellaneous)
  REGION 1..938: note = MG1-148 effector
KLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 145 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-149 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVTACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 146 - protein, 1062 aa, unidentified
  REGION 1..1062: note = Description of Unknown: uncultivated organism with predicted taxonomy: Coraliomargarita sp. CAG:312
  REGION 1..1062: note = MG1-150 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIRKDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 147 - protein, 1034 aa, unidentified
  REGION 1..1034: note = Description of Unknown: uncultivated organism with predicted taxonomy: Verrucomicrobia
  REGION 1..1034: note = MG1-151 effector
MGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKVGNAYNDKGELLLPEGVYMVNTIQTDGRGKLTNTNGDKSKPININYLMKAGMRKVSVKDL

SEQ ID NO: 148 - protein, 874 aa, unidentified; identical to SEQ ID NO: 88
  REGION 1..874: note = Description of Unknown: uncultivated organism
  REGION 1..874: note = MG1-152 effector

SEQ ID NO: 149 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-153 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAVKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 150 - protein, 1073 aa, unidentified
  REGION 1..1073: note = Description of Unknown: uncultivated organism with predicted taxonomy: Verrucomicrobia
  REGION 1..1073: note = MG1-154 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLVHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYTGINPKYNYSTLVKSIKSIVGEVPKRIISDFVLSNPKLSESEWEDWCKNNAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 151 - protein, 1074 aa, unidentified
  REGION 1..1074: note = Description of Unknown: uncultivated organism with predicted taxonomy: Verrucomicrobia
  REGION 1..1074: note = MG1-155 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNGNGKTPDSAKGEKSEAVKEEDSYAEKLALYEREFDGLLAEVNNRKKYDFPCFFKAAKIGLWSPENPDVVKIRIDNTAEKAKGYVVPRSAVVSEFRALVEAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFIPDVAAFDFANSTEFSRAVQINKLIGLQNDPIVRHRLSFFYERIKSLEAKFGTPDKIVLEFVRDDFLGKKAKADLSRAINDRAKERKKYAEELDSQREIFGSKYASKKMLLKYELYSKQKGVCVYTGNALGFSNLEQLEVEHIVPRSRGGPDALYNYVLTDEKTNKEKGDRTPFEWLSSKGLEWESYCQRVRELTKEFGAKRCRLLLSPNAEELVEKYTALAETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEKPTLEQTIYAKRLINGKETIVKKCNVRDLAYAGINPKYDLGKLKDRIRDIINPVSKRVISDFVNSNPNLSESEWEDWCRHEASIPSKSGKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDSKGVWKLKAGIYRSNTIRADGFVKLTNSDGFSSNPISIQYLMTAGMKRITLDTI

SEQ ID NO: 152 - protein, 891 aa, unidentified
  REGION 1..891: note = Description of Unknown: uncultivated organism with predicted taxonomy: Coraliomargarita sp. CAG:312
  REGION 1..891: note = MG1-156 effector
LYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 153 - protein, 1055 aa, unidentified
  REGION 1..1055: note = Description of Unknown: uncultivated organism with predicted taxonomy: Verrucomicrobia
  REGION 1..1055: note = MG1-157 effector
MENRVNIWGFDIGKGSLGEAVRIGSEIKHVQSLILDKDFGEIKTAAGIRRQYRTRKAHRAREKFLEKVLGECGIEVLRRREVGIVDGCWKLIAKGDIRLEKEFPSPGEDVCYNSIALRCKLLLGEPLESWQVFKALNSAIQNRGYDPDIPWTETDADKKEDSDWAKRLSAYEDEKKVLFSGLADPQRYDYPCFFKAYKMGLWSPEDPEIVKLRIDNHAEKAKNYVIPRKCVEAEFEKLVENASLQYPKLKGKALYIMFGPAQKEYASLNPELRRQFNLKRGADTDWTALGQKIPRFDNRIVDKCKLMPRFNVCKIKPLDEIKNPADFLPYEITTLMKLLNLRFLRNGTIESLACDELKEAFELARDNKYKLSKTALKKFLKKIGAEVLDEDQSKIEAPRSGGRASFSRPAMAVLKELILSGESPAKFYARKVSQIENTDKLKGLVASDFDFIKQMGDIAWGKIFMPDMRLLEFANRQNIDAEARINKLIGSQNDPIVRHRLGFFYDRIKFLESKFGVPDKIVIEFVRDDFLGEKAKKEYQKAINERFKEKQELAKEMDEAGYKGAKMLLKLELYKKQGGQCVYTGEALPSSEIASLEIEHIVPRSRGGPDSIYNYVLTRERTNKEKADRTPYEWLSRDQQRWNAYVSRVNSLYKSLGGKRCKLLLANNAEELVDKYTALAETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQKPRLEQTLYSKRVVGGKECIVRKFNLVDLAYKSGLKPVYDLQTIKKLVGKDQSESDIINPVVGALVREFIATDPTEEQWRAWCGEVCMPSESFTGSRIKRVLVRCGNPDEFKDLSKDGCGAYRKGDAHKGQTVWRSTNGKCYVLPIYVHASKYGLIEALKKRADFKEIVGLFRMHCLVNIERDVFDKKGQKLLPPGIYMLNTLRADSQALLTNTDGVKQKAININYLVESGMRPIKVDY

SEQ ID NO: 154 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-158 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVTARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 155 - protein, 1052 aa, unidentified
  REGION 1..1052: note = Description of Unknown: uncultivated organism with predicted taxonomy: Coraliomargarita sp. CAG:312
  REGION 1..1052: note = MG1-159 effector
MDILGNKVWGFDMGKGSLGEAVRIGNEFKHVCSLLLDADFGEIKTAASLRRQYRTHKAHKAREKWLEDCLRKCGIEVLQRRQVAFVDDKWQLVSKGDIRLEKEFPTDDENICYNSIALRCKLILGEKLESWQVFKALNSAIQNRGYDSEIPWKETEVKSKDNSDYAIKLQAFEREKDELLLNLPSIDEAIRSKFDYPCFFKAYKIGLWNPVNPNQVDSKISHTANKAKGYVIPRNYVEKEFIKLVEMASLQYPKLRNKALFILYGITEKPYASFDFDLRKKFNLKRGAESDWTALGQKIPRFDNRIVDKCKLIPRFNVCKVKHIDEIQQDKDFLYYEITLAMKLLNLRFYRNANVQSLNYDEFKILFEIGKANKFKITKTNLKKFLNSINAEILDENQAEVAQPKDSGRASFSRPAMQLIKELIFSGQSPADFYARKVSSISNVETKKGLVVEDLDFIKLMGDVDWNGIFIPDVETYKFAKNFSEDNSAQINKLIGMQNDPIVRHRLSFFYDRIKYLEAKFGIPDKVVLEFVRDDFIGKEKKKELNIAIKKRYSEKLKIAEKLDEIGFKGSKMLMKLELFQKQGGICLYTREPLLPTEIPSLEIEHIVPRSRGGPDSAYNFVLTREATNKEKANRTPFEWLSGDSQKWVSYSDRVMSRSKELGKKRCQLLLKENAEELVEKYTALAETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMKPRLEETIYSKRKIGKKEYIVRKYDLESLAYKGINPKYDVESIKKLANSENIINVVARKIIRDFVNDNPTEQEWKDFCNTVKMPSKNGNGSRLKRILLLVGNTAEYKDLSKDGCGAYRKGDSHKGQIIWKTKSGKFKVEPIYAHSSRAKVSKELMKKPEFDSVAGIFRTGCLVEFTNDVMNDKDEFLLERGIYSLNTISTAGQVAITNSNGNKSIGININYLMKAGMRRLNL

SEQ ID NO: 156 - protein, 933 aa, unidentified
  REGION 1..933: note = Description of Unknown: uncultivated organism with predicted taxonomy: unclassified Verrucomicrobia (miscellaneous)
  REGION 1..933: note = MG1-160 effector
EKLEGWQVFTALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISPTALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 157 - protein, 1074 aa, unidentified
  REGION 1..1074: note = Description of Unknown: uncultivated organism with predicted taxonomy: Verrucomicrobia
  REGION 1..1074: note = MG1-161 effector
MGTKEIVWGFDIGKGSLGEAVRIGNEFKHVQSLEIPPEFAETKTAAALRRAWRTRHAHKARELWLERCLSNAGIEVLGRRKVDIVGGRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLKRGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLIEGRETIVKKCNVRDLAYAGINPKYDLGKLKDRIRDIINPVSKRVISDFVNSNPNLSESEWEDWCRHEASIPSKSDKATRLLRVQCAVGDPAEYKDLSKDGCGAYRKGKSHKGQYIWKTKGGRYVVTPVYTFASKIRVYDDMRRDPNCEEICGFFRQNCLVEIPNDVYDNKGVLKLKAGIYRSNTIKTNGQVNLTTPNGIKFNGISIQYLMSAGMKRITLNTI

SEQ ID NO: 158 - protein, 1062 aa, unidentified
  REGION 1..1062: note = Description of Unknown: uncultivated organism with predicted taxonomy: Coraliomargarita sp. CAG:312
  REGION 1..1062: note = MG1-162 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNSKRDVLLSPGTYMINTIMAAGMAILSDTNGVKSPAININYLMNAGMRRISIKYK

SEQ ID NO: 159 - protein, 1063 aa, unidentified
  REGION 1..1063: note = Description of Unknown: uncultivated organism with predicted taxonomy: unclassified Verrucomicrobia (miscellaneous)
  REGION 1..1063: note = MG1-163 effector
MKVIEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKACKMGLWSPDNPERVEVRIGSDAQKAKGYVIPRKDVEREFERLVEAASKWYPAMKGKAMYIMYGIAETPYASFKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLPREKTNKEKADRTPFEWLSSDPVKWAGYSDRVKARAGQLGRKRCELLLEKNAEELVEKYTALAETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKKPKLEDGIYSMRMVGGKKIMARRVNLVDLAYKGGQGQKPVYDISVLMDKKNPKEKKIINPQIRKLVADFARTNPSEDEWKKWCGECRLPSKNGLGTRVIRVLLNYGEPAEYKDLSKDGCGAFRKGKEHKGQIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 160 - protein, 1074 aa, unidentified
  REGION 1..1074: note = Description of Unknown: uncultivated organism with predicted taxonomy: Verrucomicrobia
  REGION 1..1074: note = MG1-164 effector
MHTKETVWGFDIGKGSLGEAVRVGNEFKHVLSMEIDADFAEIKTAAATRRAWRTREAHKAREMWLEKCLSDADIEILGRRKVDIVDGTWKLVSRGDGRLEREFPADGENVCYNSIALRCKLLLGEKLESWQVFKALNSAIQNRGYDAQIPWGDEDGKSSETKRSGKSDSAKKSGEDESYAERLALFEREFDKLLAEVENREKYDFPCFFKAAKMGLWSPENPDKVGIRIDNTAEKAKGYVVPRNAVIAEFRALVNAAAKQYPKLKGKADFIMFGKAEEAYASYKPELRRKFGLRRGADSDWTALGQKTPRFDNRIIGKCKLIPRLNVCKIKPLKECKTEDDFLPHTITLALKLLNLRFFRGAGIDSLSFDEFLRAFEIARQNKFALNKTNLKKFFKTIGAEIMDENQSSVEQPREGGRAAYSRPAMRLLRDLIFSGKSPAEFYASRICKIENTDKNRGLVAEDLAFIKLMGDIPWNGIFVPDVDTFNFANIRESERADKINKLIGSQNDPIVRHRLAFFYERIKLLESKFGAPDKIVLEFVRDDFLGSKAKKEMSQGIKKRFEEKKKLAEELDSQRAEFGNKYASKKMLLKFELYKKQRGRCVYTDNALPLSELENLEVEHIFPRSRGGADAMYNYVLTDENTNKQKGERTPFEWLSSDKTKWESYCDRVRSLTQSLGAKRCKLLVSPNAEELMQKYTALAETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKKPELEQTIYSKRVIGGRQTIVKKCNVRDLAYKGQNPKYDFDTLTKRIKDIINPVSKRVIEDFAKTEPTEAEWEDWCKYEAAIPSKNGSPTRLLRVLVEIGNPEEYKDLSKDGCGAYRKGDSHKGQFIWKNKKGRYIVAPIYAHASKAKVLDDLQNNPDCAEICGFFRTNCLVKIPNDVADKDGKILLKAGFYKSNTIKTEGRVKLTNPNGIITEIGLQHLMNAGMKRVETNTI

SEQ ID NO: 161 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-165 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 162 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-166 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDGQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKGLGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGEFILPAGRYMVNTIRSDNQCVLTNADGEKRNPININYLMRAGMRRVDLSEL

SEQ ID NO: 163 - protein, 1055 aa, unidentified
  REGION 1..1055: note = Description of Unknown: uncultivated organism with predicted taxonomy: unclassified Verrucomicrobia (miscellaneous)
  REGION 1..1055: note = MG1-167 effector
KNNHVWGFDIGKGSLGEAVRIGGDFKHIASVLLDPEFGEIKTAALARRQMRTRKAHKAREKWLEECLEGTGVEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAVFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 164 - protein, 988 aa, unidentified
  REGION 1..988: note = Description of Unknown: uncultivated organism with predicted taxonomy: Verrucomicrobia
  REGION 1..988: note = MG1-168 effector
GRWKLVSEGDRRLEREFPADGEDCCYNSIALRCKLLLGEKLESWQVFKALNSAIQTRGYDAKIPWGNDDGKTSDSAKGGKSEAAKEEESYAEKLALYEREFDGLLAEVDNRKKYDFPCFFKAAKIGLWSPANPDAVKIRIDNTAEKAKGYVVPRSAVIAEFRALVDAAAKQYPALKGKADFIMFGVSEEPYASYNPELRKKFGLERGAESDWTALGQKTPRFDNRVIDKCKLIPRLNVCKIKPLPECRTDDDFLPYETTLALKLLNLRFFRGAGVDSLSFDEFLRAFEIAKNNKFELNKTNLKKFFKSIGAEVIDESQSKIEQPRSSGRASFSRPAMRILRNLVFSGKSPAEFYETELVKITNTDKNRGIVAEDIKFLKLMGNVPWGGIFVPDVGVFDFADSTECSRAVQINKLIGMQNDPIVRHRLSFFYGRIKSLDAEFGTPDKIVLEFVRDDFLGKKAKADLSKAINDRAKEKKKYAEELDSQRENFGPKYASKKMLLKYELYSKQKGECIYTGRALGFSDLEQLEVEHIVPRSRGGPDALYNYVLTDEKTNKDKGDRTPFEWLSSKGVEWDAYRDRVRGLTKELGAKRCKLLLSPNAEELVEKYTALAETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEKPTLEQTIYAKRLINGKETIVKKCNVRDLAYAGRNPQYSYLTLVKNIKCIVGKVSKNIISDFVLSNPDLNESEWENWCKYDAVIPSKNGAPTKLLRVLCGARNPEEYKDLSKDGCGAYRKGNLHKGQFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 165 - protein, 991 aa, unidentified
  REGION 1..991: note = Description of Unknown: uncultivated organism with predicted taxonomy: unclassified Verrucomicrobia (miscellaneous)
  REGION 1..991: note = MG1-169 effector
ECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 166 - protein, 872 aa, unidentified
  REGION 1..872: note = Description of Unknown: uncultivated organism with predicted taxonomy: unclassified Verrucomicrobia (miscellaneous)
  REGION 1..872: note = MG1-170 effector
DGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 167 - protein, 1064 aa, unidentified
  REGION 1..1064: note = Description of Unknown: uncultivated organism with predicted taxonomy: unclassified Verrucomicrobia (miscellaneous)
  REGION 1..1064: note = MG1-171 effector
EFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNESRNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGDNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVDLNEL

SEQ ID NO: 168 - protein, 1073 aa, unidentified; identical to SEQ ID NO: 133
  REGION 1..1073: note = Description of Unknown: uncultivated organism with predicted taxonomy: Verrucomicrobia
  REGION 1..1073: note = MG1-172 effector

SEQ ID NO: 169 - protein, 1046 aa, unidentified
  REGION 1..1046: note = Description of Unknown: uncultivated organism with predicted taxonomy: unclassified Verrucomicrobia (miscellaneous)
  REGION 1..1046: note = MG1-173 effector
IGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACTKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKSDFILPAGRYMVNTIRSDNQCVLTNADGEKRNPININYLMRAGMRRVDLSEL

SEQ ID NO: 170 - protein, 1059 aa, unidentified; identical to SEQ ID NO: 86
  REGION 1..1059: note = Description of Unknown: uncultivated organism with predicted taxonomy: unclassified Verrucomicrobia (miscellaneous)
  REGION 1..1059: note = MG1-174 effector

SEQ ID NO: 171 - protein, 918 aa, unidentified
  REGION 1..918: note = Description of Unknown: uncultivated organism with predicted taxonomy: Coraliomargarita sp. CAG:312
  REGION 1..918: note = MG1-175 effector
AADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRIVKKCNVRDLAYEGINPKYNYTKLVKRIESIVGDVSKRIISDFVLSNPDLNESEWEEWCKYKAAIPSKNGAPTKLLRVLFDVGSPEEYKDLSKDGCGAYRKGDSHKGQFIWKTQKGKYMVAPVYAHASKAKVFASLKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 172 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-176 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYAALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 173 - protein, 1073 aa, unidentified; identical to SEQ ID NO: 142
  REGION 1..1073: note = Description of Unknown: uncultivated organism with predicted taxonomy: Verrucomicrobia
  REGION 1..1073: note = MG1-177 effector

SEQ ID NO: 174 - protein, 1052 aa, unidentified; identical to SEQ ID NO: 155
  REGION 1..1052: note = Description of Unknown: uncultivated organism with predicted taxonomy: Coraliomargarita sp. CAG:312
  REGION 1..1052: note = MG1-178 effector

SEQ ID NO: 175 - protein, 846 aa, unidentified
  REGION 1..846: note = Description of Unknown: uncultivated organism with predicted taxonomy: Coraliomargarita sp. CAG:312
  REGION 1..846: note = MG1-179 effector
TLFRSAEKAKGYVVPREAVVREFRALVNAAALQYPNLKGKADFIMFGRACEPYASYNPELRKRFGLKRGAATDWTALGQKTPRFDNRVIDKCKLIPRLNVCRIKPLDECKTDDDFLSYTITLSLKLLNLRFFRGAGMDSLSFDEFLRAFELAKNSKFKLGKAALKKFFKTIGAEVMDESQSEIEQPRNGGRAAFSRPAMRILRDLIFSGKSPADFYATAIENIANTDKNKGLVAGDLDFLKLMGDAPWSGIFIPDVGLSDFADASEAARAAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGNALPLSELENLEIEHIVPRSRGGPDAMYNYVLTDEKTNKEKGDRTPFEWRSTMGAEWESYCARVRELTKKLGAKRCKLLLAPNAAELVEKYTALAETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNSDLSESEWEDWCKNEAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVVDKSGKMLLKAGVYRSNSVRSNGQVAITNSDGISPNPISIQYLMPAGMKRIKLDTV

SEQ ID NO: 176 - protein, 1018 aa, unidentified
  REGION 1..1018: note = Description of Unknown: uncultivated organism with predicted taxonomy: unclassified Verrucomicrobia (miscellaneous)
  REGION 1..1018: note = MG1-180 effector
IASVLLDPEFGEIKTAALVRRQMRTRKAHKAREKWLEECLEGTGVVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEMRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATSLGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 177 - protein, 1077 aa, unidentified; identical to SEQ ID NO: 111
  REGION 1..1077: note = Description of Unknown: uncultivated organism with predicted taxonomy: unclassified Verrucomicrobia (miscellaneous)
  REGION 1..1077: note = MG1-181 effector

SEQ ID NO: 178 - protein, 1061 aa, unidentified; identical to SEQ ID NO: 112
  REGION 1..1061: note = Description of Unknown: uncultivated organism with predicted taxonomy: unclassified Verrucomicrobia (miscellaneous)
  REGION 1..1061: note = MG1-182 effector

SEQ ID NO: 179 - protein, 1062 aa, unidentified; identical to SEQ ID NO: 92
  REGION 1..1062: note = Description of Unknown: uncultivated organism with predicted taxonomy: Coraliomargarita sp. CAG:312
  REGION 1..1062: note = MG1-183 effector

SEQ ID NO: 180 - protein, 1059 aa, unidentified; identical to SEQ ID NO: 127
  REGION 1..1059: note = Description of Unknown: uncultivated organism with predicted taxonomy: unclassified Verrucomicrobia (miscellaneous)
  REGION 1..1059: note = MG1-184 effector

SEQ ID NO: 181 - protein, 1062 aa, unidentified; identical to SEQ ID NO: 122
  REGION 1..1062: note = Description of Unknown: uncultivated organism with predicted taxonomy: Coraliomargarita sp. CAG:312
  REGION 1..1062: note = MG1-185 effector

SEQ ID NO: 182 - protein, 1054 aa, unidentified; identical to SEQ ID NO: 123
  REGION 1..1054: note = Description of Unknown: uncultivated organism with predicted taxonomy: unclassified Verrucomicrobia (miscellaneous)
  REGION 1..1054: note = MG1-186 effector

SEQ ID NO: 183 - protein, 957 aa, unidentified
  REGION 1..957: note = Description of Unknown: uncultivated organism with predicted taxonomy: Verrucomicrobia
  REGION 1..957: note = MG1-187 effector
LRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 184 - protein, 1062 aa, unidentified
  REGION 1..1062: note = Description of Unknown: uncultivated organism with predicted taxonomy: Verrucomicrobia
  REGION 1..1062: note = MG1-188 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQENSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKTKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 185 - protein, 1073 aa, unidentified; identical to SEQ ID NO: 113
  REGION 1..1073: note = Description of Unknown: uncultivated organism with predicted taxonomy: Verrucomicrobia
  REGION 1..1073: note = MG1-189 effector

SEQ ID NO: 186 - protein, 1059 aa, unidentified; identical to SEQ ID NO: 90
  REGION 1..1059: note = Description of Unknown: uncultivated organism with predicted taxonomy: unclassified Verrucomicrobia (miscellaneous)
  REGION 1..1059: note = MG1-190 effector

SEQ ID NO: 187 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-191 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGENVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 188 - protein, 1081 aa, unidentified
  REGION 1..1081: note = Description of Unknown: uncultivated organism with predicted taxonomy: unclassified Verrucomicrobia (miscellaneous)
  REGION 1..1081: note = MG1-192 effector
YYIVDFCSHCKYFNNNKEFNKNMEKEKNNHVWGFDIGKGSLGEAVRIGGDFKHIASVLLDPEFGEIKTAALVRRQMRTRKAHKAREKWLEECLEGTGIEILKRREVGIVDGQWRLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDGHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLSEL

SEQ ID NO: 189 - protein, 1073 aa, unidentified; identical to SEQ ID NO: 150
  REGION 1..1073: note = Description of Unknown: uncultivated organism with predicted taxonomy: Verrucomicrobia
  REGION 1..1073: note = MG1-193 effector

SEQ ID NO: 190 - protein, 1059 aa, unidentified; identical to SEQ ID NO: 129
  REGION 1..1059: note = Description of Unknown: uncultivated organism with predicted taxonomy: unclassified Verrucomicrobia (miscellaneous)
  REGION 1..1059: note = MG1-194 effector

SEQ ID NO: 191 - protein, 1059 aa, unidentified; identical to SEQ ID NO: 93
  REGION 1..1059: note = Description of Unknown: uncultivated organism with predicted taxonomy: unclassified Verrucomicrobia (miscellaneous)
  REGION 1..1059: note = MG1-195 effector

SEQ ID NO: 192 - protein, 935 aa, unidentified
  REGION 1..935: note = Description of Unknown: uncultivated organism with predicted taxonomy: Verrucomicrobia
  REGION 1..935: note = MG1-196 effector
MGAEFRHVTSLLLDEDFGEIKTAAGLRRQIRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPAFRKKFDLKRGAESDWTALGQKIPRFDNRIIDKCRPIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGK

SEQ ID NO: 193 - protein, 1059 aa, unidentified; identical to SEQ ID NO: 116
  REGION 1..1059: note = Description of Unknown: uncultivated organism with predicted taxonomy: unclassified Verrucomicrobia (miscellaneous)
  REGION 1..1059: note = MG1-197 effector

SEQ ID NO: 194 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-198 effector
MEKEKNNHVWGFDIGIGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 195 - protein, 899 aa, unidentified
  REGION 1..899: note = Description of Unknown: uncultivated organism with predicted taxonomy: unclassified Verrucomicrobia (miscellaneous)
  REGION 1..899: note = MG1-199 effector
SKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPCFDNRIIDKCRLIPRMNVCKIRPLNEARNEKDLLYYEVTLALKLLNLRFFRNSNIEQLTFEEFKEAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKAFGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 196 - protein, 1073 aa, unidentified
  REGION 1..1073: note = Description of Unknown: uncultivated organism
  REGION 1..1073: note = MG1-200 effector
MYTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYECIKSLEAKFGVPDKIVLEFVRDDFLGKKAKSDLNKAIKTRFDEKKKLAEDLDSKREEFGFKYASKKMLLKFELYKKQGGKCVYTGNALPLSELESLEIEHIVPRSRGGPDAMYNYVLTDEKTNKEKGDRTPFEWLSTMGAEWESYCERVRKLTKELGAKRCKLLLSPNAAELVEKYTALAETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRNGRIVKKCNVRDLAYTGINPKYNYSTLVKSIKSIVGEVPKRIISDFVLSNPKLSESEWEDWCKNEALIPSKNGAPTKLLRVLCDVGSPEEYKDLSKDGCGAYRKGDSHKGQFIWETKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 197 - protein, 1073 aa, unidentified; identical to SEQ ID NO: 121
  REGION 1..1073: note = Description of Unknown: uncultivated organism with predicted taxonomy: Verrucomicrobia
  REGION 1..1073: note = MG1-201 effector

SEQ ID NO: 198 - protein, 1073 aa, unidentified
  REGION 1..1073: note = Description of Unknown: uncultivated organism with predicted taxonomy: Coraliomargarita sp. CAG:312
  REGION 1..1073: note = MG1-202 effector
MYTKEIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYYPELRKRFGLKRGAATDWTALGQKTPRFDNRVIDKCKLIPRLNVCEIKPLDKCKTDDDFLSYTITLSLKLLNLRFFRGAGVDSLSFDEFLRAFELAKNSKFKLGKAALKKFFKTIGAEVMDESQSEIEQPRNEGRAAFSRPAMRILRDLIFSGKSPAEFYAAAIENIANTDKNKGLVAGDLDFLKLMGDAPWSGIFIPDVGLSDFADTSEAAREAQINKLIGSQNDPIVRHRLSFFYERIKSLEAKFGVPDKIVLEFVRDDFLGKKAKSDLNKAIKTRFDEKKKLAEELDSNRAEFGPKYASKKMLLKYELYKKQGGKCVYTGKALPLSELENLEIEHIVPRSRGGPDAMYNYVLTDEKTNKEKGDRTPFEWRSTMGAEWESYCERVRKLTKELGAKRCKLLLAPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEKPTLEQTIYAMRKGRIVKKCNVRDLAYEGINPKYNYTKLVKRIESIVGDVSKRIISDFVLSNPDLNESEWEEWCKYKAAIPSKNGAPTKLLRVLCDAGNPEEYKDLSKDGCGAYRKGDSHKGQFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 199 - protein, 1062 aa, unidentified; identical to SEQ ID NO: 146
  REGION 1..1062: note = Description of Unknown: uncultivated organism with predicted taxonomy: Coraliomargarita sp. CAG:312
  REGION 1..1062: note = MG1-203 effector

SEQ ID NO: 200 - protein, 1073 aa, unidentified; identical to SEQ ID NO: 107
  REGION 1..1073: note = Description of Unknown: uncultivated organism with predicted taxonomy: Verrucomicrobia
  REGION 1..1073: note = MG1-204 effector

SEQ ID NO: 201 - protein, 759 aa, unidentified
  REGION 1..759: note = Description of Unknown: uncultivated organism with predicted taxonomy: Coraliomargarita sp. CAG:312
  REGION 1..759: note = MG1-205 effector
FPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYAAAIENIANTDKNKGLVAGDLDFLKLMGDAPWSGIFIPDVGLSDFADASEAAREAQINKLIGSQNDPIVRHRLSFFYERIKSLEAKFGVPDKIVLEFVRDDFLGKKAKSDLNKAIKTRFDEKKKLAEDLDSKREEFGFKYASKKMLLKFELYKKQGGECVYTGNALPLSELESLEIEHIVPRSRGGPDAMYNYVLTDEKTNKEKGDRTPFEWRSTMGAEWESYCERVRKLTKELGAKRCKLLLSPNAAELVEKYTALAETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEKSKLEQTIYSLRKGRKIGRA

SEQ ID NO: 202 - protein, 1062 aa, unidentified; identical to SEQ ID NO: 130
  REGION 1..1062: note = Description of Unknown: uncultivated organism with predicted taxonomy: Coraliomargarita sp. CAG:312
  REGION 1..1062: note = MG1-206 effector

SEQ ID NO: 203 - protein, 1036 aa, unidentified
  REGION 1..1036: note = Description of Unknown: uncultivated organism with predicted taxonomy: unclassified Verrucomicrobia (miscellaneous)
  REGION 1..1036: note = MG1-207 effector
MKVMEAENGNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARDEGDLLHYEITLSLKLLNLRFFRNSNVESLSFEEFKAAFEIAKGAKYKMGKAALKKFLKSISASVLSEDQSEIEAPRESGRASFSRPAMLLLKELIFSGMPPAEFYAKKAGEISNADPNKGIVASDLDFIKLMGNCGWNGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPTEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIKTDGRGKLTNPN

SEQ ID NO: 204 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-208 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 205 - protein, 1059 aa, unidentified; identical to SEQ ID NO: 106
  REGION 1..1059: note = Description of Unknown: uncultivated organism with predicted taxonomy: unclassified Verrucomicrobia (miscellaneous)
  REGION 1..1059: note = MG1-209 effector

SEQ ID NO: 206 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-210 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 207 - protein, 1062 aa, unidentified; identical to SEQ ID NO: 83
  REGION 1..1062: note = Description of Unknown: uncultivated organism with predicted taxonomy: Coraliomargarita sp. CAG:312
  REGION 1..1062: note = MG1-211 effector

SEQ ID NO: 208 - protein, 1059 aa, unidentified; identical to SEQ ID NO: 85
  REGION 1..1059: note = Description of Unknown: uncultivated organism with predicted taxonomy: unclassified Verrucomicrobia (miscellaneous)
  REGION 1..1059: note = MG1-212 effector

SEQ ID NO: 209 - protein, 798 aa, unidentified
  REGION 1..798: note = Description of Unknown: uncultivated organism with predicted taxonomy: unclassified Verrucomicrobia (miscellaneous)
  REGION 1..798: note = MG1-213 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 210 - protein, 920 aa, unidentified
  REGION 1..920: note = Description of Unknown: uncultivated organism with predicted taxonomy: unclassified Verrucomicrobia (miscellaneous)
  REGION 1..920: note = MG1-214 effector
MLEVAAYAHGLAERAFSDVKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 211 - protein, 1059 aa, unidentified; identical to SEQ ID NO: 137
  REGION 1..1059: note = Description of Unknown: uncultivated organism with predicted taxonomy: unclassified Verrucomicrobia (miscellaneous)
  REGION 1..1059: note = MG1-215 effector

SEQ ID NO: 212 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-216 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDQLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVIIREKTNKLKGDKTPYEWLSSDAKEWASYTDRVNACAKALGKKRCRLLLEKDAEELVEKYTALAETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 213 - protein, 777 aa, unidentified
  REGION 1..777: note = Description of Unknown: uncultivated organism with predicted taxonomy: Coraliomargarita sp. CAG:312
  REGION 1..777: note = MG1-217 effector
GSDSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 214 - protein, 1059 aa, unidentified; identical to SEQ ID NO: 125
  REGION 1..1059: note = Description of Unknown: uncultivated organism with predicted taxonomy: unclassified Verrucomicrobia (miscellaneous)
  REGION 1..1059: note = MG1-218 effector

SEQ ID NO: 215 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-219 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSPKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 216 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-220 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEGKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCHLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 217 - protein, 759 aa, unidentified
  REGION 1..759: note = Description of Unknown: uncultivated organism with predicted taxonomy: unclassified Verrucomicrobia (miscellaneous)
  REGION 1..759: note = MG1-221 effector
FNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFAVPGALTSRIRKFYGLDRILHNSEAESENLSFEE

SEQ ID NO: 218 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-222 effector
MEKEKNNHVWGFDIGKGSLGEAVRIGGDFKHISSVLLDPEFGEIKTAALARRQMRTRKAHKAREKWLEECLEGTGVEILKRREVGIVDGQWQLISKGDERLEREFPPSDEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVGPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 219 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-223 effector
MEKEKNNHVWGFDIGKGSLGEAVRIGGDFKHIASVLLDPEFGEIKTAALVRRQMRTRKAHKAREKWLEECLEGMGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 220 - protein, 1025 aa, unidentified; identical to SEQ ID NO: 141
  REGION 1..1025: note = Description of Unknown: uncultivated organism with predicted taxonomy: unclassified Verrucomicrobia (miscellaneous)
  REGION 1..1025: note = MG1-224 effector

SEQ ID NO: 221 - protein, 1062 aa, unidentified; identical to SEQ ID NO: 81
  REGION 1..1062: note = Description of Unknown: uncultivated organism with predicted taxonomy: Coraliomargarita sp. CAG:312
  REGION 1..1062: note = MG1-225 effector

SEQ ID NO: 222 - protein, 1062 aa, unidentified; identical to SEQ ID NO: 114
  REGION 1..1062: note = Description of Unknown: uncultivated organism with predicted taxonomy: Coraliomargarita sp. CAG:312
  REGION 1..1062: note = MG1-226 effector

SEQ ID NO: 223 - protein, 899 aa, unidentified
  REGION 1..899: note = Description of Unknown: uncultivated organism with predicted taxonomy: Coraliomargarita sp. CAG:312
  REGION 1..899: note = MG1-227 effector
MNNNNTQIWGFDIGKASLGEAVWCGGEFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASRFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIIGDCPWNGIFIPDVETYKYASQTQESSEAQINKLIGSQNDPIVRHRLSFFYERIKALSEKFGVPDKIVLEFVREDFMGKQAKKDLSLYMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNED

SEQ ID NO: 224 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-228 effector
MEKEKNNHVWGFDIGKGSIGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLGFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFTATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVCNDKGDFILPAGRYMVNTILTTGRCVLTNADGEKRNPININYLMRAGMRRVDLNEL

SEQ ID NO: 225 - protein, 1059 aa, unidentified
  REGION 1..1059: note = Description of Unknown: uncultivated organism with predicted taxonomy: Verrucomicrobia
  REGION 1..1059: note = MG1-229 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETSYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGYDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLNEL

SEQ ID NO: 226 - protein, 1059 aa, unidentified
  REGION 1..1059: note = Description of Unknown: uncultivated organism with predicted taxonomy: Verrucomicrobia
  REGION 1..1059: note = MG1-230 effector
MEKEKNNHVWGFDIGKGSLGEAVCIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTTLAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 227 - protein, 1059 aa, unidentified; identical to SEQ ID NO: 87
  REGION 1..1059: note = Description of Unknown: uncultivated organism with predicted taxonomy: unclassified Verrucomicrobia (miscellaneous)
  REGION 1..1059: note = MG1-231 effector

SEQ ID NO: 228 - protein, 1073 aa, unidentified; identical to SEQ ID NO: 126
  REGION 1..1073: note = Description of Unknown: uncultivated organism with predicted taxonomy: Verrucomicrobia
  REGION 1..1073: note = MG1-232 effector

SEQ ID NO: 229 - protein, 1034 aa, unidentified; identical to SEQ ID NO: 110
  REGION 1..1034: note = Description of Unknown: uncultivated organism
  REGION 1..1034: note = MG1-233 effector

SEQ ID NO: 230 - protein, 1058 aa, unidentified
  REGION 1..1058: note = Description of Unknown: uncultivated organism with predicted taxonomy: unclassified Verrucomicrobia (miscellaneous)
  REGION 1..1058: note = MG1-234 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYAVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGCGAYRKGDGHKGQVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 231 - protein, 1059 aa, unidentified; identical to SEQ ID NO: 115
  REGION 1..1059: note = Description of Unknown: uncultivated organism with predicted taxonomy: unclassified Verrucomicrobia (miscellaneous)
  REGION 1..1059: note = MG1-236 effector

SEQ ID NO: 232 - protein, 1056 aa, unidentified
  REGION 1..1056: note = Description of Unknown: uncultivated organism with predicted taxonomy: Verrucomicrobia
  REGION 1..1056: note = MG1-237 effector
MEKEKNNHVWGFDIGKGSLGEAVRIGGDFKHIASVLLDPEFGEIKTAALVRRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 233 - protein, 1062 aa, unidentified; identical to SEQ ID NO: 97
  REGION 1..1062: note = Description of Unknown: uncultivated organism with predicted taxonomy: Coraliomargarita sp. CAG:312
  REGION 1..1062: note = MG1-238 effector

SEQ ID NO: 234 - protein, 1061 aa, unidentified; identical to SEQ ID NO: 131
  REGION 1..1061: note = Description of Unknown: uncultivated organism with predicted taxonomy: unclassified Verrucomicrobia (miscellaneous)
  REGION 1..1061: note = MG1-239 effector

SEQ ID NO: 235 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-240 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLNEL

SEQ ID NO: 236 - protein, 1062 aa, unidentified; identical to SEQ ID NO: 81
  REGION 1..1062: note = Description of Unknown: uncultivated organism with predicted taxonomy: Verrucomicrobia
  REGION 1..1062: note = MG1-241 effector

SEQ ID NO: 237 - protein, 1062 aa, unidentified
  REGION 1..1062: note = Description of Unknown: uncultivated organism with predicted taxonomy: Coraliomargarita sp. CAG:312
  REGION 1..1062: note = MG1-242 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGENLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVESEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 238 - protein, 1074 aa, unidentified; identical to SEQ ID NO: 151
  REGION 1..1074: note = Description of Unknown: uncultivated organism with predicted taxonomy: Verrucomicrobia
  REGION 1..1074: note = MG1-243 effector

SEQ ID NO: 239 - protein, 1059 aa, unidentified; identical to SEQ ID NO: 96
  REGION 1..1059: note = Description of Unknown: uncultivated organism with predicted taxonomy: unclassified Verrucomicrobia (miscellaneous)
  REGION 1..1059: note = MG1-244 effector

SEQ ID NO: 240 - protein, 1062 aa, unidentified; identical to SEQ ID NO: 97
  REGION 1..1062: note = Description of Unknown: uncultivated organism with predicted taxonomy: Coraliomargarita sp. CAG:312
  REGION 1..1062: note = MG1-245 effector

SEQ ID NO: 241 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-246 effector
MKVMEAENRNHIWGFDIGKGSLGEAVLMGAEFRHVTSLLLDEDFGEIKTAAGLRRQMRTRKAHKAREKWLERCLLEFGIEPLKRREVGIVNGRWMLISKGDERLEREFPPDGEDICYNAIALRCKLLLGEKLESWQIFKALNSAIQNRGYDENIPWKESDVSLPKKDDDDYAKKLSQYSREKGELLESFEDGEKYDYPCFFKAYKMGLWSPENPERVEIRIGNDAQKAKGYVIPRKDVEREFESLVEAASKWHPAMKGKAMYIMYGIAETPYASFKPALRKKFDLKRGAESDWTALGQKIPRFDNRIIDKCRLIPRLNVCKIRPLSEARGEGDLLHYEITLSLKLLNLRFFRNSNVESLSFEEFKAAFEIAKSAKYKMGKAALKKFLKSISASVLSEDQSEIEAPRESGRASFSRPAMLLLKELIFSGMPPTEFYAKKAGEISNADPNKGIVASDLDFIKLMGNCGWSGIFIPDVETYRFANNGADSAKLINGLIGSQNNPIVRHRLAFFYERIKFLESKFGVPDKVVLEFVREDFMGKEQKKRMQIEMKKRASEKMLIAKKLDEAGYKGGNLLLKMELLEKQGGICLYTGEPLLPSELGVLEIEHIVPRSRGGPDAQYNYALTREKTNKEKADRTPFEWLSSDPVKWAGYSDRVKARAGQLGRKRCELLLEKNAEELVEKYTALAETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKKPRLEDGIYSMRAVGGKKFMARRVNLVDLAYKSGLKPVYDISALIKLLDKKEKGIINAQIRKLVADFARTNPSEDEWRKWCGECRLPSKNGIGTRVIRVLLNYGEPAEYKDLSKDGRGAFRRGDGHKGQIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 242 - protein, 1062 aa, unidentified
  REGION 1..1062: note = Description of Unknown: uncultivated organism with predicted taxonomy: Coraliomargarita sp. CAG:312
  REGION 1..1062: note = MG1-247 effector
MNNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPDKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINGKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 243 - protein, 1034 aa, unidentified; identical to SEQ ID NO: 147
  REGION 1..1034: note = Description of Unknown: uncultivated organism with predicted taxonomy: unclassified Verrucomicrobia (miscellaneous)
  REGION 1..1034: note = MG1-248 effector

SEQ ID NO: 244 - protein, 1059 aa, unidentified; identical to SEQ ID NO: 149
  REGION 1..1059: note = Description of Unknown: uncultivated organism with predicted taxonomy: unclassified Verrucomicrobia (miscellaneous)
  REGION 1..1059: note = MG1-249 effector

SEQ ID NO: 245 - protein, 1062 aa, unidentified; identical to SEQ ID NO: 158
  REGION 1..1062: note = Description of Unknown: uncultivated organism with predicted taxonomy: Coraliomargarita sp. CAG:312
  REGION 1..1062: note = MG1-250 effector

SEQ ID NO: 246 - protein, 1062 aa, unidentified; identical to SEQ ID NO: 184
  REGION 1..1062: note = Description of Unknown: uncultivated organism with predicted taxonomy: Coraliomargarita sp. CAG:312
  REGION 1..1062: note = MG1-251 effector

SEQ ID NO: 247 - protein, 1060 aa, unidentified; identical to SEQ ID NO: 139
  REGION 1..1060: note = Description of Unknown: uncultivated organism with predicted taxonomy: unclassified Verrucomicrobia (miscellaneous)
  REGION 1..1060: note = MG1-252 effector

SEQ ID NO: 248 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-253 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGREISEISNTDKNKGVVSSDLDFIKLMGDCPWGGIFIPADLTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 249 - protein, 1059 aa, unidentified; identical to SEQ ID NO: 136
  REGION 1..1059: note = Description of Unknown: uncultivated organism with predicted taxonomy: unclassified Verrucomicrobia (miscellaneous)
  REGION 1..1059: note = MG1-254 effector

SEQ ID NO: 250 - protein, 1059 aa, unidentified; identical to SEQ ID NO: 134
  REGION 1..1059: note = Description of Unknown: uncultivated organism with predicted taxonomy: unclassified Verrucomicrobia (miscellaneous)
  REGION 1..1059: note = MG1-255 effector

SEQ ID NO: 251 - protein, 1059 aa, unidentified; identical to SEQ ID NO: 119
  REGION 1..1059: note = Description of Unknown: uncultivated organism with predicted taxonomy: unclassified Verrucomicrobia (miscellaneous)
  REGION 1..1059: note = MG1-256 effector

SEQ ID NO: 252 - protein, 1059 aa, unidentified; identical to SEQ ID NO: 143
  REGION 1..1059: note = Description of Unknown: uncultivated organism with predicted taxonomy: unclassified Verrucomicrobia (miscellaneous)
  REGION 1..1059: note = MG1-257 effector

SEQ ID NO: 253 - protein, 1074 aa, unidentified; identical to SEQ ID NO: 157
  REGION 1..1074: note = Description of Unknown: uncultivated organism with predicted taxonomy: Verrucomicrobia
  REGION 1..1074: note = MG1-258 effector

SEQ ID NO: 254 - protein, 1059 aa, unidentified; identical to SEQ ID NO: 161
  REGION 1..1059: note = Description of Unknown: uncultivated organism with predicted taxonomy: unclassified Verrucomicrobia (miscellaneous)
  REGION 1..1059: note = MG1-259 effector

SEQ ID NO: 255 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-260 effector
MEKEKNNHVWGFDIGKGSLGEAVRIGGDFKHIASVLLDPEFGEIKTAALACRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWISSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGCGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 256 - protein, 1059 aa, unidentified; identical to SEQ ID NO: 94
  REGION 1..1059: note = Description of Unknown: uncultivated organism with predicted taxonomy: unclassified Verrucomicrobia (miscellaneous)
  REGION 1..1059: note = MG1-261 effector

SEQ ID NO: 257 - protein, 1061 aa, unidentified
  REGION 1..1061: note = Description of Unknown: uncultivated organism with predicted taxonomy: unclassified Verrucomicrobia (miscellaneous)
  REGION 1..1061: note = MG1-262 effector
MKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 258 - protein, 1055 aa, unidentified; identical to SEQ ID NO: 153
  REGION 1..1055: note = Description of Unknown: uncultivated organism with predicted taxonomy: Verrucomicrobia
  REGION 1..1055: note = MG1-263 effector

SEQ ID NO: 259 - protein, 1075 aa, unidentified
  REGION 1..1075: note = Description of Unknown: uncultivated organism with predicted taxonomy: unclassified Verrucomicrobia (miscellaneous)
  REGION 1..1075: note = MG1-264 effector
MSLYFIEQISDWKIMKVMEDEGGNHIWGFDIGKGSLGEAVLDGSEFKHVASLLLDADFGEIETAAGLRRQMRTRKAHKAREKWLESCLSGFGIETLKRREVGIVNGQWTLISKGDERLEREFPPDGENICYNSIALRCKLLLGEKLEGWQIFKALNSAIQNRGYDENIPWKESDASPSKKEGGDYAQKLSQYSREKSELFESFEGGEKYDYPCFFKAYKMGLWSPDNPERVEVRIGSDAQKAKDYVIPRKDVEREFERLVEAASKWYPAMKGKAMYIMYGIAETPYASYKPLLRKKFDLKRGAESDWTALGQKIPRFDNRIIDKCRLIPRLNVCKIRPLSKIRGEADLLHYEITLSLKLLNLRFFRNSNVESLSFGEFKAAFEIAKGAKYKMGKAALKKFLKSISASVLSEDQSEIEAPRESGRAAFSRPAMLLLKELIFSGMTPAEFYAKKSGEISNADPNKGIVASDLDFIKLMGNCGWSGIFIPDVDTFHFANKGAEPAKLINELIGSQNNPIVRHRLSFFYERIKFLESKFGIPDKVVLEFVREDFMGKEQKKRMQIEMKKRASEKMLIAKKLDEAGYKGGNLLLKMELLEKQGGVCLYTGEPLLPSELGVLEIEHIVPRSRGGPDAQYNYVLTREKTNKEKADRTPFEWLSSDPVKWAGYSDRVKARAGQLGRKRCELLLEKNAEELVEKYTALAETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKKPKLEDGIYSMRTVGGKKIMARRVNLVDLAYKSGLKPVYDVSVLIKLLDKKERGIINPQIRKLVADFARTNPSEDEWKKWCGECRLPSKNGLGTRVIRVLLNYGEPAEYKDLSKDGRGAFRRGDGHKGQIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 260 - protein, 1063 aa, unidentified; identical to SEQ ID NO: 159
  REGION 1..1063: note = Description of Unknown: uncultivated organism with predicted taxonomy: unclassified Verrucomicrobia (miscellaneous)
  REGION 1..1063: note = MG1-265 effector

SEQ ID NO: 261 - protein, 1022 aa, unidentified
  REGION 1..1022: note = Description of Unknown: uncultivated organism with predicted taxonomy: Coraliomargarita sp. CAG:312
  REGION 1..1022: note = MG1-266 effector
NNNNTQIWGFDIGKASLGEAVWCGGKFKHVESLILDKDFAEIKTSAGRRRQARTRKAHKAREEWLEKCLEDCGIEILKRRKVGIVNGQWKLISKGDARLEKEFPAEGEEVCYNSIALRCKLILGEKLESWQIFKALNSSIQHRGYDENIPWKETQNESKKEDGDYFKKIVLYESEKEDILNRLPQECKREDFDFPCFFKAKKMGIWSEENPYKVGLRISNNAQKAKGYVIPRKYVENEFVRLVQMASLQYPKLKDKQMFILYGISETPYASLFKDARKKFGLKRGADSDWTALGQKIPRFDNRMIGKCKLIPRLNTCKIKSPEKIKSEEDLLHYDITLALKLLNLRFFKDSEICALSFEEFKKLFEIGKSNKYKISKTDLKKFLKSIGASVLSQDHSEIEAPRTSGRSSFSRPAMKILKELIFSGEPPSKFLKAKIDKIANTDPNKGIIREDLDFIRIMGDCPWNGIFIPDVETYKYASQTQESSEAQINKLIGSQNDPIVRHRLSFFYERIKALSEKFGVPDKIVLEFVREDFMGKQAKKDLSLSMKKRFEEKIDIAKKLDDIGYKGNKMLLKMELLQKQGFACLYTGEALQETDLPILEIEHIVPRSLGGPDAAYNYVLTSESTNKAKGNQTPYKWLSPDRDKWRAYTERVRARAAELGSKRCRLLLSENAEELINKYTALAETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKKPKLEESIYSKRTINRKECIVRKFNLVDLAYKSGLKPVYDISAIEKLLEDKPKKIPPIINPTVRRIVRDFVSTNPNEDEWRNWCKTVRMPSKNRNGTRIIRVLVYVGTPEEYKDLSKDGCGAFRKGDSHKGQIIWMDKNGRYKVSPVYVHSSKSQTMESIKSNPDFIKIAGFFKSHCLVEIESPVVNGKRDVLLSPGTYMIN

SEQ ID NO: 262 - protein, 1073 aa, unidentified
  REGION 1..1073: note = Description of Unknown: uncultivated organism with predicted taxonomy: Verrucomicrobia
  REGION 1..1073: note = MG1-267 effector
MHTKDIIWGFDIGKGSLGEAVRVGNEFKHVQSLEIAPDFAETKTTAAARRAWRTREAHKARELWLEKCLSEAGIEVLLRRKVGVVDGAWKLVSKGDVRLEREFPPAGEDLCYNSIALRCKLLLGEKLESWQVFKALNSAIQNRGYDANIPWGDEDAADGGDGSSRKSSDSDASGDGESYAEKLAHYEREFDGILAELDNREKYEFPCFFKAAKMGLWSPENPDFVGVRIDNTAEKAKGYVVPREAVVREFRALVNAAALQYPNLKGKADFIMFGRACEPYASYNPELRKRFGLKRGAATDWTALGQKTPRFDNRVIDKCKLIPRLNVCKIKPLDECKTDDDFLSYTITLSLKLLNLRFFRGAGVDSLSFDEFLRAFELAKNSKFKLGKAALKKFFKTIGAEVMDESQSEIEQPRNGGRAAFSRPAMRILRDLIFSGKSPAEFYATELGKIANTDKNKGLVAGDLDFLKLMSDAPWSGIFIPDVGLSDFADTSEAARAAQINKLIGSQNDPIVRHRLSFFYERIKSLEAKFGVPDKIVLEFVRDDFLGKKAKSDLNKAIKTRFDEKKKLAEDLDSKREEFGLKYASKKMLLKFELYKKQGGECVYTGNALPLSELENLEVEHIVPRSRGGPDAMYNYVLTDEKTNKEKGDRTPYEWHSLKGAEWDSYCDRVRELTKNLGAKRCRLLLAPNAAELVEKYTALAETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEKSKLEQTIYSLRKGRIVKKCNVRDLAYEGINPKYNYTKLVKRIESIVGDVSKRIISDFVLSNPDLKESEWEDWCKYEAAIPSKNGAPTKLLRVLCEVGSPEEYKDLSKDGCGAYRKGDSHKGQFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 263 - protein, 1059 aa, unidentified; identical to SEQ ID NO: 100
  REGION 1..1059: note = Description of Unknown: uncultivated organism with predicted taxonomy: Verrucomicrobia
  REGION 1..1059: note = MG1-268 effector

SEQ ID NO: 264 - protein, 1078 aa, unidentified
  REGION 1..1078: note = Description of Unknown: uncultivated organism with predicted taxonomy: unclassified Verrucomicrobia (miscellaneous)
  REGION 1..1078: note = MG1-269 effector
VDFCSHCKYFNNNKEFNKNMEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPELKGRAKFILYGVSETPYASYYGNMRKKFGLKRGAESDWTALGQKVPRFDNRIIDKCRFIPRMNVCKIRPLNEARNEKDLLYYEVTLALKLLNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARIMRVLVYYGEADEYKDLSKDGYGAYRKGDGHKGQVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 265 - protein, 1055 aa, unidentified; identical to SEQ ID NO: 98
  REGION 1..1055: note = Description of Unknown: uncultivated organism with predicted taxonomy: Verrucomicrobia
  REGION 1..1055: note = MG1-270 effector

SEQ ID NO: 266 - protein, 1059 aa, unidentified
  REGION 1..1059: note = Description of Unknown: uncultivated organism with predicted taxonomy: unclassified Verrucomicrobia (miscellaneous)
  REGION 1..1059: note = MG1-271 effector
MEKEKNNHVWGFDIGKGSLGEAVRIGGDFKHIASVLLDPEFGEIKTAALARRQMRTRKAHKAREKWLEECLEGTGVEILKRREVGIVDGQWQLISKGDERLEREFPPSGEDVCYNSIALRCKLLLGEKLEGWQVFKALNSAIQKRGYDENIPWGEAEEKSSKKDDDDYAQKLSQYEKEKSELFESFADGEKYDFPCFFKAYKMGLWSPENPTRVEVRIDCRAQKAKSYVIARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLFNLRFFRNSNIEQLTFEEFKKAFEIAAGAKYKMTKTAMKKFLKSISATALGDDYAEIEPPKESGRASFSRPAMEILKELIFSGMPPREFYGRKISEISNTDKNKGVVSSDLDFIKLMGDCPWGGIFIPDVQTYQFANAAFPDPDAQINKLIGSQNNPIVRHRLTFFFERIKFLESKYGVPDKVVLEFVRDDFMGEKEKKEMRIAMKKRAEEKMRIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVMRVLVYYGEADEYKDLSKDGYGAYRKGDGHKGQVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 267 - protein, 1273 aa, unidentified
  REGION 1..1273: note = Description of Unknown: uncultivated organism
  REGION 1..1273: note = MG1-272 effector
MKDYVLKAANQSPTNNDSFLTGLVFGFDVGTGSIGYAVRKKDKFLDAGVLICPEGINDLSGRNGLRRGRRTLDHRQNRRDWFAENLAKVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFL

SEQ ID NO: 268 - protein, 992 aa, unidentified
  REGION 1..992: note = Description of Unknown: uncultivated organism with predicted taxonomy: Rhizobiales
  REGION 1..992: note = MG1-273 effector
MDKTDYVLKNKPEPASNDKFLTGLVFGFDVGTGSIGYAVRKGSEFKDVGVLICDSEGSELEGRRNLRRQRRTIRSRKSRREWFARELVKLGLPKSETALDDPISLRLRALNGEVLKPEELHAALTHLFKRRGYTKVPWANVEAVRKDGEKAKKEEGDTQKAISELEQEMKNAGCDYPCQLLDQRRKKLGERPQTKWGRNFPWGRATLEKEFWKIVEAQKEHCPELAKNAEKLLHGNTHKVTRIIDGQKREFHVYFKTDKEHKAGVLGVRWPKFENRSPGLDALEPFRKDPKTGAWIPQHTMRRDNLLFKEWQLEKSLHDFRVKRRMISSGRSKKEKFEFIPPPPAALAALRKLWNERGHLWAADLQEWAKAYEGQFELHYPDRDLTPRNNFSGRARFSKIGMASIRKVIDEARVRHDVAYEAWELKFKEKNKEAKEEDIFNGYARFLTQQSNAPVLAAGVADNSYARTVAPPPVLILPGETPEAAFQRYLNAIRDPQVRHRVELFGRELRRLMTLHSQNQAPDFIVIEMARDLMMNQEQKDAKEAKDKERRKERDEAAQILRDMGFAPDADNIKKFLLAQEAGWRCPFTLRPFCQSDFSQLTVTQLIQAENKPRFVKEASSVFDRLEIEHLVPRTPVVCNEWFNLTVTLHSTNAQKRKRTPFQWLFADKDGLPADLDWERIRKNAVERFGESSLKYQVFTSPDGAKLVEDNAKKSIQQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNAQAFDTTIYGRRENFGGEILPQTLFVARKRLLDLKVSHLDPRGKGGFIFSKLLRDHIEKEWKLFSGDEKNWLRVQSDWM

SEQ ID NO: 269 - protein, 1258 aa, unidentified
  REGION 1..1258: note = Description of Unknown: uncultivated organism
  REGION 1..1258: note = MG1-274 effector
MPKENESSFLNGLVFGFDVGTGSIGYAVRKGAEFLDVGVLICDSKGSDLSKRRELRRQRRTLRSRKYRRQWLANELSELGLTKPVPSPDDPVSLRLRALNGEALKPEELHAALTHLFKRRGYSKVPWAKVEALRKNGEKAKQEDSDTQKGITELEQEMNEKGCTYPCQLLDLRRKDAGTLPKRKWGRNFPWGRQMLETEFRAIAEAQKDHFPELVQNVESLLHRNTLEIRREVDGKKQTFHVFFKTDTGKKPGVLGIRWPKFENRGPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 270 - protein, 1260 aa, unidentified
  REGION 1..1260: note = Description of Unknown: uncultivated organism
  REGION 1..1260: note = MG1-275 effector
VLISAQWKTISTNLSIMDYIIKPAPGSTSSPYDWANDPFYKSAIVLGIDIGIEGIGVWLRKGRNHVFARTFLFNTPEAAPLKGRRLLRGGRRCRQSEQHREVLLKQFCAEFGLPWTEIKDQENEDGPFKLRLRAVRSKLGSKEALVVCLRHIIRHRGYDYHETDGGSFPWGDELKADVATGWAKAAYCSPEDAAEFLHDVSDCGWNDKQLASFRHALTAAVERHKQGIEAALEKHFAQDKNNLRIPARKHNFPRSLIWKHMEKICANHRDFLGGEAGLSAALLKLKPILNYHRKKPGALAERKVNRCPVAIHLFGGTAPKCDPNSNPHIRRFKLLEFLATRSFVAKDGTRLLANADLMKWLLDEVLAEDIRAVVVNKVKGGQKQERRKFGGFRDEFIARFDPNGKIELAGDRVSHNKDFFEQLGDLLRPKLSVLNARASICGKSAEELFKRATKDGYQAEIISRNLKEKQFDGQSFYTLRQAAAAGFGIYPQVEFLLGRRGKKGNQAVPGVLRQMLELPEVSAKLDGQKIPDYVIIETVGDMPRNVVQAKEIQDEQKRRREFKEGLFEKFGVHDKQQDSEARKRVLLYDQQGGNRGEAICPYTGEPLGDPLSPKLQIDHIFPESLGGISEMVNLVLTHETTNNQRKGNQTPYQAFGGQQNTAEWQALVARVQKMGWNKQKRELVLREESSCPEWDNMTRIAQLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNRSKKSRFQQWIYGFPDKNGQMWARDSLKSLADKANLLELLRDAGIGENQLPTSHFEEWQEKRKAQFFTREEAWAAVEALALPPEQKIPEPIFEEWWSYRFSGDKRKVDEKLLRILIAKAGVKESVSKERLASVLTNRGDPGPLTRKDGTPINGVSGTAKQMTPMAIIPHRNHKREIIGFKLATESFVRAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 271 - protein, 780 aa, unidentified
  REGION 1..780: note = Description of Unknown: uncultivated organism with predicted taxonomy: Verrucomicrobia bacterium IMCC26134
  REGION 1..780: note = MG1-276 effector
LFGPPARAYASFFVEERKRHGLREGSASDWQGVLSQKIPRFDNRIIGKCVLIPRLNVCKIRTGPDGGLLPQSRVAAEVVFLMKLKNMRLHRDGGARGLTAAEIGKILGDPKRSKLGLTPTQWKKWCVRFGGLPLPGQYEEVEEPRFSGRSRFCRPALEILRRLILSGDAPPLAHEKEVARLNGNTDPLKGLVPDDLRFLKQMGSTWEGIYVPNQKLDALARLTDDPQEAIRRLIGSQNDPIVRHRLALFAKRLDYLAVTKKFGPPDYVVLEFVREDFMGQKAKLEYLKFQRERARARAEAREEAAKAGATENSAGLKMELHKAQGGICLYTGDGLAVTSLDDYDIDHIVPESQGGPDALLNKVLTTRLANREKANRTPYEWLASSDRWDAYVERGKKRLTTLRNKKVQLLTSPEATALVEKYTALAETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEKAAFEETCYGRRTLQGEQFAVGREDLSGLAVRLVGAKRVLKKRADIETHRIVDARIRSDVEAFLDANVGLTLEAWGAWCSTYKQGGNGPRVAKVMVTKSKADSLEEYKDVSKDGTGQLRRGAKHRGYFVYEHLAATKKDPDRKQLEVRPVYVHESKKAVAAGITGRIYAYFESGCLVRLAKPWVFQGKPYPPGQYICTSIWANRNAKLRHPEYGDIGPVGLRLLLDAGFERVE

SEQ ID NO: 272 - protein, 1068 aa, unidentified
  REGION 1..1068: note = Description of Unknown: uncultivated organism
  REGION 1..1068: note = MG1-277 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSPNREVLISLGFDPINFLRISMNDLMRVLGHELPHPPSVKPQSESSD

SEQ ID NO: 273 - protein, 788 aa, unidentified
  REGION 1..788: note = Description of Unknown: uncultivated organism with predicted taxonomy: Pedosphaera sp. Tous-C6FEB
  REGION 1..788: note = MG1-278 effector
MKSAKPQPMKTIWAFDLGKGSIGEAVRLDDKFPHAESLLIPAELARRGPATVSGTPANRYRALKTREAHHERERWLETVWKSAGLIPLYPREVWENPNTGKWELKRNGDHRLEREFAPKLGEKTKDGAPSDEAGAEVCYTSCLLRINLLQGNKLADWQIFKALRAALQCRGYGPVPWATKEARKQGRTAEEIQLEEEKKLQQADARYRDAVGKWPEFKRSVPAQFHFACYYDASKIGLWDVSNPNIFLHRANHLAASTRNVRFDRVDVRAEMIKLGDQAAAILPELRIAFARWQKDGWKFRHPNGKELTYPVRAKTFGEFLCDGPAGKPDETSFEAFLSQRRDVKVQRGSYEEWMAALGQKTPSFDNRILNICVLIPRFHVCKVDVRLETQKDENKKDKFTGNIVPESLLASEVTFLLKLKNLLVADGQRKLTAGEIQFVFNYAHRQLKELKLVTPGGELIKNWPGKIADCFALSKSEWGGKKSLSKLALRPLPGHEEVKAPKTSGRSAYSRVALRILKELILSGEAPSVFHAKLLRRDADLLRRLGSNSDRPLVLFDDSVAKDEKQRERENNENRKHVVLVSEVHFLCQMRKDNSAADSWENIFIPSQTLDALQQRHTNDGKLDADDAIQELLGTINDPIVRHRLGVFAGRLKKLQHGDGKEETPKCGVPDFIVLEFAREDFMGEEAVKKYQRFLNDRADERKKAREEAEKLGLESRSSGLRYELFKAQGGICLYTGKSLGETSLDDYEIDHIVPRSLGVPDAALNYVLTFHDVNHAKEKGKLTPYA

SEQ ID NO: 274 - protein, 1024 aa, unidentified
  REGION 1..1024: note = Description of Unknown: uncultivated organism
  REGION 1..1024: note = MG1-279 effector
MKDYVLKNKPEPASNDKFLTGLVFGFDVGTGSIGYAVRKGADFKDVGVLICDSEGSDLSKRRDLRRQRRTLRSKRFRRQWFAKELVKLGLPKSETALDDPISLRLRALNGEELKPEELHAALTHLFKRRGYSKVPWANEAKIVKETAKSKKDDDEGIIKEAVKEMKAKLGDKHPCQFLAEEKARVGNSPTTNWARKIYWPREVLRAEFLAILKAQQNNFPQLAEKADWLLYGDSQAKEKNGETFHVFFKSTEARNPGVLGLRWPRFDNRGPALDSLQPVDGQGRPLHVVRKNKEAFGNAQWELALMNFRVLDVETRQKRDPRTDFPIFIENVRNEWNKKGKVTEARLKTLAKPFKDKFLLIKDQKPLTPDHGGGRARYSSPTLDLIHKEISEGRRVDPPQPILQRKGENAEQALNRYLADVKHPVVQHRLVLFRRLLMQLVSRYGQPDMIVLEAVRSLALGQKAKNELNQRNEKFRKERENAREQLSSNKESFSRKAIQRYRLWQEAKGRCPFCLQMIERTELGHGADIEHLVPRSIVDCNEFYNLTVAHIKCNRELKGDRTPFAAFSGTSQWPDIKDHAEKTFFGRKLEIFLSPDAEQLIEQKSDLQHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHKRTYDTTIYGKKSSNVYVAREKLTDLKEKDFESVYPKIFGVYIAAAWERFTTETPGLPEMLKATKNKLPEMFARKLCFSHFQNWREKKPVAFDWPDKVRIPIRSVKYIGVHDDKAVAKASSGTHGYVARGGYKEVRIHKTTDGKGWVPVFVPYWKGDRLIHEQPFQAEKPVQTIRLGDLIELKNGYGPNNPPGTYRVVSTMQKQIQLMPPNIADTKEALKASGYLENGINLRWPAFFKAAGYELPHPPSVKP

SEQ ID NO: 275 - protein, 1214 aa, unidentified
  REGION 1..1214: note = Description of Unknown: uncultivated organism
  REGION 1..1214: note = MG1-280 effector
KVLGLSLHKGTRLPNTAWTQNEKAGWIPVSPKFANPVSLRIDALGGKPLTAEQLFTALAHLIKHRGPSEKVPWSKTIAEEQRDLDEKESVSDTIPADQVRAEFEKARKEFTLSNADASGFHPAHYLQQLGEERKLQRKRAWPRDLVETEAAAILEAQANHHQKLKEEIKFVDVSGENRKATVAEWLLHGNSSIKSVREGDAEMSFHVFDRNYPNRERAPFTFQAARIHNRKPGLDLVEPRDEFGRPRYVMSRERPEYGQWQVEVALLNFKVLDLTSLKKDKAKIVPSAEALAELREIITRTGRLSVEDLQTWIKPYKENGIYDLVKEQPALVGEGKGRGRFSRVGLQRATEIIRPLQTEHNAMSKLTPKGQRAKKKLKTPEDKADAYVRQYVNYTPKLRYAWKNPATQITEPEPLPRALRRYILEIRDPVVRHRVELFDRMLDDLLGKYRSDGNPTHIVIECVRELEQDAEAAQDAWERRKKDREENQTARATLKDMGVKAPTDKDVRKFRLLQECKWRCPYTLERFMQTEFDDLVIQRIVPPAGDPRRSAYLEAARSAMQGTQVEHMVPQAAIVCDEWFNVTVTRPTTNTTKGDRTPYDFVLRDGDKDRRKQLLENAEQCFGKDSLKFKIFSSDNARSLIQERDKLQRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHKQVFDSGLYGKRTTYGGKPLEKDEPVFFVIAKQLSRLTPAVLSYPAKGGGDSIFSPKLREHIASAWKTYTADNANWQHLLTRSEEDLQRELQDAENSKDNQYKFKTIKALKDRLRRVSQWRVAIPNETLWAELQEYLQQEKARRLKKPEARNNVFPDHFIEGLRHPNYNTPIHSVKVIALTKDEDAYVELRTGSKTFWKYKGGYEAMRVYGSPPKTRTGKGKFICWLVRRFYKRKKKENGQLQTVKEAHAAAMPAVCQGQKLLATFHNGQVVRFKQLAKDMDISHNWIICETNADTRNPRNSKIVVMPAHLAKIVADPENPKRTISLKETEGVPLFLNEFMWALGYETPTKDNELPHPTSVKPQS

SEQ ID NO: 276 - protein, 837 aa, unidentified
  REGION 1..837: note = Description of Unknown: uncultivated organism with predicted taxonomy: Thermoflexibacter ruber
  REGION 1..837: note = MG1-281 effector
ESPTDYWGRKLYWLRELLEAEFRAITEAQQKYFPQLAEKSDWLLYGDSQPKKTKDEETFHVFFKATEARSPGVLGLRWPRFDNPGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPNGKKFITQFVRPWVRKGIAEQSSIPEGSKHICTLTKGDILVMKNADLEKKIEAGTRWILKKTFSSGRVSILPSHLSP

SEQ ID NO: 277 - protein, 947 aa, unidentified
  REGION 1..947: note = Description of Unknown: uncultivated organism
  REGION 1..947: note = MG1-282 effector
MKDYVLKNKPEPASNDKFLTGLVFGFDVGTGSIGYAVRRGADFKDVGVLICDSEGSDLSKRRDLRRQRRTLRSKKFRRQWFAKELAKLGLPKSQTALDDPISLRLRALNGEALKPEELHAALTHLFKRRGYSAVPWAKETKETVKPKTEDDDGEILKQAHGLKAEMDKRGCKHPCQYLAQRRKEVGESPTDYWGRKLYWLRELLEAEFRAITEAQQKYFPQLAEKSDWLLYGDSQPKKTKDEETFHVFFKATEARSPGVLGLRWPRFDNRGPALDSLQPVDEQGRTQHVVRKNKEAFTKAQWELALMNFRVIDRASGKLVAPDRKSLVRLREIWESGKRKKKKESASDTEESETIKISEPVLKRWAKDFVGQYKLVDGQQPLTPQTGAGRARYSSPTLERIIAGEQFNPPQPLLRRKNESPEQALNRYMTDIKHPLVRHRLILFQRLLKKLVSQFGEPDTIVMEAVRSLALGKTKKRELIQRIHNNREERDGIRKELSKDGFSSSKNSILRYRLFKEAKGRCPFCLCPFCLQAVLFKEAEIEHIVPRSRVDCNEFYNLTVAHADCNKKKDNRTPWEAFGQTPDWEALRRNAEECFGLGSMKYKLFTNPDAQDLVEEKSDLQHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKRQFFDTTRYGKRGKDLFIARKVLAKMNPKQLAKIYPESQSLYLTEAWNRFTAENPNVDLLLKEENRGKEQGAKVALPGKFISRLCFSEYQRWVESQKTSAPLGFRWPERVKIPFKSVSVIADDGDSAMFETKLGSKTYVSQTEFKEVRVFLPPN

SEQ ID NO: 278 - protein, 1319 aa, unidentified
  REGION 1..1319: note = Description of Unknown: uncultivated organism with predicted taxonomy: Verrucomicrobia bacterium IMCC26134
  REGION 1..1319: note = MG1-283 effector
MDKTNYVLKNKPEPAANETVWAFDLGKGSIGEAVRRGNEFLHKASLLIPAELARRGPAKVSGTPANRHRALKTREAHYERERWLETVWRTAKVTSLLTPLRPREVWENPETHKWELKHPADYQLEREFAPAEFRRNSKTGEKEKIVYPNGHAENDGAPASTSEDFNLCYTSCLLRIKLLNGDSDLKAWQIYKALRAAIQCRGYGKVPWAAKEARKQGKTAEELELEEEKKLLQADPRYREAVGRWPDFKRSIQKLKLPLFDGMQPRKADNFYFVPPCYYDASKMGLWNPSAPDKLLSHSNLANSTRNVRFDRFDVRNELIMLGDQAAALLPEIRDAFARWQREGWKIKHPVTGKELTYPVHAKTFGEFFCDGPAGKPDETSFEAFLNQREKAGLHRGSFEEWMAALGQKTPSFDNRILNDCTLIPRFHVCKVDLKLETAKHGEITGKILSESLLASEVTLLLKLKNLLISDPVNGQRKLTVEEVRDVFAYAQRQLKALNLIAADGDLIKGWPEKVADRFALNNSDWEKIAAEAEFFRKMSAFNLSQGGENRRLTEVEIYSLLRAAADSKRKLEHELPDNLKTLFKAAKAEWKKAKVVADTTMLRPLTNHEIVKAPKTSGRSGYSRVALRIIKELILSGQAPSVFHARLLRRESKLLGKLGASPAKPLCLFADSTATSEEQRKKEDTENRKRGLLESELNFLLQMRKDDATEDSWKDISPPSQTIDALQQRHTKGNKLDADAAISELLGSINDPIVRHRLEVFDKRLKKFELGDVKESIPAFGVPDAIVLEFVREDFMGEKAKRELKDFQDKREAARKKAREKATAAGSEEKSAALKFELCEAQGFICLYCGQPFATTKLNECRIEHIVPTAQGGPDAMVNYVAAHDECNEAKGKQTPFQWWHHNTSGKAPTISWDGYKALVDKYATTLRNKKVQLLTREDAVELVGRYTALAETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYERPVLRDRAYGQRDNKTMMVQRTPLRELAYKPVQQKLVYDLTYAVDQIKDVRDERIKQELQKFIAASPEEPAWNVFCDRLGKGELESLPGIKVSKVSQNLNGDLSEYKDMSKDGCGAFRRRKERHRGQFVYLDEKGKPRVEVVRVFDSIAKVKTELGAKGQGIKIIGFFQSDCLVKIGKPVAHGTITLAPGTYQLNKIVKEGQGRVQVTSAGGEKSPAISLSKFLEAGFERVD

SEQ ID NO: 279 - protein, 1053 aa, unidentified
  REGION 1..1053: note = Description of Unknown: uncultivated organism
  REGION 1..1053: note = MG1-284 effector
MKFNISTNTDPFLTGLVFGFDVGTGSIGYAVRRGSTFLPDGVGVLICDSEGSKLDERRNFRRQRRTLRSKKFRRQWFAKELVKLGLPKPTKEQLKRANNETNEQFDQRTNPVSLRVRALNEPLEKWQLFIALTHLFKRRGYEKDVPWANKEKDTKANKENDAEEWGSGTVPPEKVQSEFDASGCKYPCEFLARNPKHQRRRVWPRVLLENEFHAIAKAQTENKNFPQLTEKTNWLLYGETKEVKGHHVYFKTTEAQNPGVLGLRWPRFDNRGPALDSLQPLDEQGRPLHVVRKNKETFRKAQWELALINFRVIDRATGNLVRPDDKSLTRLREIWESGKRKKKKESGSNAAESEIIKISEPVLKRWAKDFAGQYKLVDGQQPLTPQTGAGRARYSSPTLERIIAGEQFNPPQPLLRRKNESAEQALNRYMADIKHPLVRHRLTLFQKLLQQLVSRFGEPDMIVLEAIRSLAMGEKKRREHIQRIKENRDERESIRTELKKDNFSSSKNSILRYRLFKEAKGRCPFCLCPFCLQEVVYKEAEIEHIVPRSRVDCNEFYNLTVAHQECNKKKDSRTPWEAYGTTKDWEALRKNAEDCFGLGSLKYRLFTNPDAQNLVEEKSDLQHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQQSYATTLYAKKAENKYVAREVFTSLTPKNLGNIWPDKFALYCEAAWRRYSDESANLEGELKKTKGNVPASFTNKLCFAHFQKWRADDCPEFYWPKEIKIPIRSVRLISVKDDTAVVPFSPGTHAYVKRTGFKEVQVFLAEDEKSFVPAFIPHWKSDKPICEKPIKADRKPIAVIRRGELVKLLKPTGPKNPPGAYRVSTTMQDNIQLIPAHIAKDKDALLASGFLANGVTISWKSFFAAVGYELPHPPSVKSQPPGAAEA

SEQ ID NO: 280 - protein, 1065 aa, unidentified
  REGION 1..1065: note = Description of Unknown: uncultivated organism with predicted taxonomy: Verrucomicrobia
  REGION 1..1065: note = MG1-285 effector
MITYELKKVALQNQTDEIVWAFDLGKGSIGEAVRRGNEFLHKASLLIPAEFAETRTARDRRRMFRTREAHKAREKWLCKVMHEAGIEILHGRNYDAAGNWKLGEPAEKRLEQEFPAPGDDTCYTSCLLRIKLLRGEKLEPWQVFKAFHSAIQRRGYDKDIPWKTRESRNPKAKDGDDDDAGTEKRMHDFELALEKMAPGKTAFHFPAYFDAHEMGLWSPDKPDGLKLRSDCHAKTTRNQIVPRKLVEAEIRQMVEGAAKHYPALADKADYLLYGIAQQSYASYKPELRQKFKLREGGATDWQGVVGQKIPRFENRIIAKCALIPRLNVCKLREGEKGQPHEKSLVAVEVAFLMKLKNLRVQRPGGNGWLSAEEIRGILEDPKRKDWKITESVWRKYCVRIGAGWLLGHEEVKSPRFSGRSRFCRPALEVLKRLILSGQKPSKFLQEEIVRLNGNKDPLKGLVEADLKFIGDMAAKNDAWEGIYIPNQQLDALVELSSDSAEAITTLIGRQNDPIVRHRLSVFYKGLRELEQTTKSRPDQVVLEFVREDFMGKKAKIEYFSFIKRRAEERIKAREEAANAGATEKSAGLKLELLRAQDGCCLYTNEGLVPSRLDEYQIDHIVPRSKGGPDAVVNYALTTQKANEAKADRTPYDWFHQEMPDKWDAYVNRVRSRATHLRNKKVQLLVALNAAELADKYTALAETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQKAAFEETIYGQRTIDGHKFIVGRESLASLAIKTTQNSQTIKKVSDIEFGRIVDARIQKDVKEFWESNPAATLESWKKWCADYRLGANGPLVNFVLVKKSKEDAVEEYKNVSKAGVSSERGQYKRGAKHRGYYIYERPAPTRKEPNKMQVEVCPVFVFQSKKAVQENLLKQTGIKMHGYFESGCQVRTQREWEFQGKKYPADEFILGSVWANRNAKFRHPIHQEIGPVGLRILLDAGFERI

SEQ ID NO: 281 - protein, 1294 aa, unidentified; identical to SEQ ID NO: 16
  REGION 1..1294: note = Description of Unknown: uncultivated organism with predicted taxonomy: Verrucomicrobia
  REGION 1..1294: note = MG1-287 effector

SEQ ID NO: 282 - protein, 1294 aa, unidentified; identical to SEQ ID NO: 16
  REGION 1..1294: note = Description of Unknown: uncultivated organism
  REGION 1..1294: note = MG1-288 effector

SEQ ID NO: 283 - protein, 808 aa, unidentified
  REGION 1..808: note = Description of Unknown: uncultivated organism with predicted taxonomy: Pedosphaera sp. Tous-C6FEB
  REGION 1..808: note = MG1-289 effector
VGNTQEHVWAFDLGKGSIGEAVRQGNDFKHKESLLIPHELARRGPAAVSGTPANKYRAKKTREAHLERERWLDTIWKVAGLTPLQARAVWENPETQKWELKHKGDYRLEREFAPKQFKKGAGGELVPIKYPNGKATDGAPAEKKADFETCYTSALLRIRLLQGDPSLKDWQIFKALRAALQSRGYGPVPWATKEARKQGRTPEELAREEEKKLQSADPRYREAVNKWQAFKDSVPKAFHFPCYFDAWKLGLWLHAKPDELGCRINHLAESTRNIRFDRADVRVELIRLGDQAAEILPALKKAFSDWQSGGWKYQHPVTGEKLTYPLRAKTFGEFLCDGPAGTPDESSFEAFLDQRHKAGLNRGSFEEWMAALGQKTPSFDNRILNNCVLIPRFHVCKMDVRLVMDEQGKLTGQIVTESLLATEVTLLLKLKNILVADPSAKDGQRKLTVGEVQDILAYAHRRLAELELVAADGTLLNLWPSKVAQRFSISKSSWRDVAVEAEFLRRMTASNIVVGSETRRLTIAEASSLLRAIANPKKGLEAQLPKDLQLLTKTAKSEFKKAKTASDEKTLRPMPGHEEVKAPKSSGRCGYSRVALRILKELILSGQAPSAFHSRLRELDTELLRKLGSSPEKPLVLIDDSKSQDQEQRKKENIENGKRGLLVSELNFLRQMRKERATEDSWENLFIPSQTIDALQQRHTQDGKLDSQSAIRELLGTINDPIVRHRLGVLAERLRKLQCGDEKRDSPGFGVPDAIVLEFVREDFMGEEAKREYQNFINEREKDRKAAREEAGKLGFDSRSSGLRYELW

SEQ ID NO: 284 - protein, 1048 aa, unidentified
  REGION 1..1048: note = Description of Unknown: uncultivated organism with predicted taxonomy: Deltaproteobacteria bacterium RIFOXYA12_FULL_61_11
  REGION 1..1048: note = MG1-290 effector
MTETSVLNERFHHGLVIGLDVGTAGLGWAVRRGPDLLDLGVLVVPEKVGNLEERRTLRRMRRTIRSRRQRMQQLRAMLTEVGLPSPGANAELDSPAVLRLQALNGEPLRPEELHAALFHLWKHRGWLDAWWKKKTVERTADDEPELTAEQKTAQKEAKETAARIAGLLAAMKDRGCRFACHYLALKEGRWDRTMGCLPRPKPGQAIAPEGHKNLIFPRELLREEFLAIVEAQRERWPTLYVARERILYGAWGEDSHHPAPEAAGRQHRLHGGVWHQRQARFDNRKPGKCVACGVNNVCRADAPEFAEAQRAIVLGNYRVFSAVQGKAVPVGQAALPELADILAKHQAGLKELRALAKTGGYTPLEPGIKKKDQARDLLVQQWADRNGYELLPGQQLTARKLSDGRCAFCRPCLRAVRYEYERTGTIRTFQPLLRRPGESLASARARYVRELRNPLVRQRVEALDRLLDRLERDHGSPAVIVVEAVRSLGLGKKANDDLKKKQATQREEREAARQEAAEHHAAGSQAVLRFRLAKEVGKVCPYCHQPFHADLADAEIEHILPRALGGSDQQVNLTVAHTHCNHEKHDQLPHAAWGEADRWPCLERFAREHFKGLKLQLFLHQGNPEEALALLAPPADLTQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQKMMNTTAYGPRPQRDRKGKETTVLVTRVPLVQLKEKQLNDIYPQVLMRYIAAALSEFRRTHGDEHAFQQKAPNTGKLSPAFVATLHNPGTGRPIHKVHVLGKDPAACREVRPNVFVEYTDATAYLVYPDPKKGRTWAVYLVKPWEKLGQLRASFPTPVYVFQKKQLIEFPREVVVSATNKAQAGKYRFMSCNKNGNVRLCPAHIVQGKEGFLSAGLPYYGFELHIRHLMEALGYGASPPPPAEAGVAAHPRPEPPHPQRRRGRRA

SEQ ID NO: 285 - protein, 932 aa, unidentified
  REGION 1..932: note = Description of Unknown: uncultivated organism with predicted taxonomy: Candidatus Termititenax aidoneus
  REGION 1..932: note = MG1-291 effector
ERLLREFPKDGDNTIYTSCLLRIALLQGKKLDGWQIYKAVWSAIQHRGYDKNLPWITRIKRNIEEENEDDSGAKNESTMDEKENIEGVGNYYKYLKDNFGDNKEFWYPCYYEAHKIGIWSPANLNDLSVKIGTNPNSARNKGKDKNYAVIPRELIKKELEELLKKAAEQFHKIKGKEKYIIYGLAEKEYASYIDKTFYKYRGKNWEWQGLLGQKVPRFDNRIISKCALIPRLNVCKAGDQLNKEVTFLMKLKNTKYVSHAGEELSFTSEQINKLFEKYKEKAYITKTQLEKWIKTELNGYSHPVHIKIDKSKTSGRSRFCRPALLIIKEIILSGKSPHDIYKEKITNNIITDSNKGLINGDYYFLLNMPKEWEKFWIPDKRENFSKISENKRIEEIETTIGEINNPIVRHRLNIFCDRLKKLKQKFSEPKKIVIEFIREDFMGDKKRREYIKIMNQRRKAKDEAFNEIKDLVKGKQSLIKQLLLKEQGCKDIYSYETLIPSQLNDYEIDHIVPRSKGGSDAMYNKVLTKASNNQEKGNRIPFEWLSADKEKWNMFYKNVESFRLNWKKKELLLAKDPTLLIEKYTTLAETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEKPVLAETIYGKRTVNENGEKKEYFISKMKTGLEKEWYLDVINAKKYSKDIFDSRINKDFTREIEKNPTQEEWEKFVNIYFKNNRPKKLSLIQSDSPEIFKEINSIKGQYFTDKREHQGQLVYKNEKKWKVEPVFVYESLYLKRKEYEKKYGKVYFFNSLCQVKTNKDISFGRSNQLLSKGFYILRTITEGGQVKLESNNGLEFVIALSILMEEAQMERVD

SEQ ID NO: 286 - protein, 983 aa, unidentified
  REGION 1..983: note = Description of Unknown: uncultivated organism with predicted taxonomy: Candidatus Termititenax aidoneus
  REGION 1..983: note = MG1-292 effector
ERLLREFPKDGDNTIYTSCLLRIALLQGKKLDGWQIYKAVWSAIQHRGYDEKNHWKNDDDSAENKKNVNEYIKYCKDNKFEEKYWLPCYVDAHRMGIWSPEDSNNLYRKRNNETNPAPARNKNHSKYHLVFPRSKVEEELKHLLSQAAKLFPKLAGKENYIVYGPGEVQYASMKKMEFSKYRGKEWDWQGLLGQKIPRFDNRMLNKCCCMSHFNVCRADDMLNQEVMFLMMLKNMRYHSKNKPDEMLTAEQIKELFNKFKDRLKFEKNEKDKVKNRKKEVIPKSLLRKWVIEKLNGEIHPAHSLIPMPNAGGRSRYCRPALEVIREVILSGKTPKQVYEECVAKNKIENPEQNSKKGRIQSDFDFLIKKGTSEKWENFYISDNRYELREMSADERKIEIEKTLNEINNPIVSHRLKWFKKELNKLAFGEPEKKNPGYGIPEKVVLEFARDEFMGKQAKEDYYKFIKEQTKERKIVVEELEKAGFSKPSGEMIRKMMLFRQQDGIDFYSMQNIKLSHLGEYEIDHVIPRSRGGSDAFYNIILTTNKNNSAKGDKTPYEWLGKGDIWDNISEKLKVNKKMGSKKKLLFMASSEEQYKLLIDKYTQLSQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSKAQLAEVLYGKREVKKEDGLWYTYAITRQNEGTRIEDYYVKKSEKKSDIEDMEKLRNKILKKVNHIFSNDIRTDFKKKLEEKPTEEQWNDFIKNYKVNGTCPHRISVIGNPGVKGFKEKQPLPPNYKEIRPNSKQYYETKTGQKWSYTAQLICLNEKDEWEVHPVYAWDSLYERIKKAEQEFKKVVKFHSRQSVEIKNDCANGKIKKGIYILATIQNGNWGVLESQGEKIDASLNELMNIGEMWPII

SEQ ID NO: 287 - protein, 983 aa, unidentified; identical to SEQ ID NO: 286
  REGION 1..983: note = Description of Unknown: uncultivated organism with predicted taxonomy: Elusimicrobia bacterium HGW-Elusimicrobia-1
  REGION 1..983: note = MG1-293 effector

SEQ ID NO: 288 - protein, 1033 aa, unidentified
  REGION 1..1033: note = Description of Unknown: uncultivated organism with predicted taxonomy: Endomicrobium proavitum
  REGION 1..1033: note = MG1-294 effector
MADEKLIYSFDLGSGSLGICVREGSNIKYLDSLLIDSEYASIKEVANRRRQIRTRLAHKARESWWIQQAQSAGIEVLSTKQPNKNNPNDKADVKMLKQFDKNDNQTIYSSLLLRIALLQGKKLEGWQIFKAVWSAMQRRGYEKVPWANDSDAEKNSKAVTEYEKKLENLFGDKKEYYYPCYYEAYIQGIWSPSEPSNFSKKLSNNPEPIRNKDKENMIVPNRELVYKELKDLLTQAAKQYPKLKGKEDFIIYGPSEEKNASYNNPKYKKYRGTNWDWQGLLGQKIPRFDNRIISKCKLIPRLNVCKANKKLNKEVTFLLMLKNMRFTKDGVTSCSLNHEQIRKLFETYKDNFSTKESRTNKALINSKKWKNYLEEIGAEANPNQKDIPQPKLCGRSKFCRPALNILHSLILSGKNPHDYYKELISVNNNTNPQKGLIKDDYKFLLNMPNDWNSISIQDTREEDKNLNEEERLYKIDRIISATQNRIARHRLLVLFEYLQKLKKQYGEPEKIVFEIAREDFAGEEKRKEYIDTQNKNTKNIELAVKLLKEANKQLNNRNILKARLLIEQNNVDLYEIDEHRKISITNIDDYEIDHIIPRSRGGSDSFSNFVITSINNNQTKLNRTPYEWFHQDKSFDAWNTYIKNIEGIKGLSKHKIKLLISDKAIELENKKTDLQATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTKPKLRETIYSLKCRKENGKNLYYFVSRFEKNISMFKILSDAKKQVEKIFSLQIQKDFNDKLNDKNLTQEKWEKFLDEYTLNGRKIKKVSMIDSKSFKENDVFDINGNIKKIIGEYGQNKINGQWIKAKESHQGQIAFKENNKWKIVPIYVFESKYLKLKQYKEKYNDILFFKTGDLVELTKNYDEVKAGIYKLRTLKSSGTTKLTSLDTYEDIEKTISMFIEKCGMKLYKK

SEQ ID NO: 289 - protein, 1049 aa, unidentified
  REGION 1..1049: note = Description of Unknown: uncultivated organism with predicted taxonomy: Verrucomicrobia bacterium 12-59-8
  REGION 1..1049: note = MG1-295 effector
RLRMSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVEEIHQLLKEARQRAKEARQNGETEEHIAAAYSLNKTEWKKWLKKNCHAPISTHPCIEAPSSTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKKKLQKFQNENRKAWDQARSQARELNLSGGGNVRKLRMLREQNFICPYTGDTLSENEVDTLEVEHIVPRARGGSDNQYNKVVTRTRTNREKGDHTPYEWLTQKEEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKASLQETFYGTRLLEGSAGGKTVVVRTKITELGVTFNKFDQKKALKEAASIIDPFLKESIISALESRDFKLNEWQEWCQNFRHPRTEARVLKVQITAQKPDTKEYVNMAKEGEEDGFRGQYKLGAQHQGYFVYLEKDKKGNDIPKVRPVYAFHSHRKVEKELRAQGCDVIGFFQSQCLVEFKNDYEHGNIVIPAGKYILSTILSDGRFKLEGINDIPCPLKKIQDIRHSFRRVDGPDQ

SEQ ID NO: 290 - protein, 1089 aa, unidentified
  REGION 1..1089: note = Description of Unknown: uncultivated organism
  REGION 1..1089: note = MG1-296 effector
MNKIFSFDLGSGSIGECVREGKNILHLNSLLIDNDFASLAEVRKNRRAFRTRIAHKSREDWWRHCAKIGKLEILSTEQPSVKNPYAKPDKRMLTEFSKEGDNTIYTSCLLRIALLQGQKLESWQIYKAVWSALQHRGYDANVPWAKNIREIQKKKKEELTAKEKELLKDLEEENKASKLYSEKISVLPQEYQFPCYFEAYTLGLWNPNNPNNFIRNINCSTKNIRNKENREQIIIPRSFIQKELRQMLDNARKQYPNLPETDFILYGTPKKEYASYYKPAENKKYEREGILGQKIPRFDNRMISKCCCMPRFNVCKANDELSIEVRFLLALLNMRFTKGNTTTAQLSPEELKQIFEKYKGNLSNIKNDNVLVIKQAEWKKEIENKIGGKVNENQKAIPHPNTTGRTKYCRPALEVLKDLILSGKNPHDFYEEQIAKLNNTDPMKGIVKEDLSFLKLMPNKWEKIYIPDQREENKQLSFEEAQVKIEDIIKNITNAVVKHRLTMFYRRLTALTQQYGMPNKVVLELAREEFLGEDKRAQYIKTQNENRKDKDLAKEELMTVIKSADPSYQTKLLKVRLLREQHYKDVYDLTENCALSIQDIDDYDIDHIVPISCGGADSMVNKVLTKKELNETKKQNQTPYEMYFQNASAETWAKYLEHLKDVYGKNISKHLEKKYELLTSDKAIEIESKRNDLQATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKAPPLRETIYALRCRKEKGVDKYYMVSRFNTELKTNFGDLKEASKQIDKIFDYQIKKDLQAKLADKPTKEEWLNFLENYKLLGKTPVYKVAMIASKAFSKEEVFDENGNKRHVIGEYKEMGKMKGQYLMPKEGNKGQIIFKQGKKWKVTPIYPFDSVTVKLKAAKQKYGKALFWSSGDTLILQNDIEGSEIYKEETKELVEYKNKKGKILTREKISSKEKTRPATLPKGKYKLNTLKTEGRIIITNLSSSKKYVTNLNIFIEGKVYKEK

SEQ ID NO: 291 - protein, 969 aa, unidentified
  REGION 1..969: note = Description of Unknown: uncultivated organism with predicted taxonomy: Verrucomicrobia bacterium 12-59-8
  REGION 1..969: note = MG1-297 effector
MSEKSERLVFAFDVGTGSLGLAARRGNTMLEARSLLLDENYGKRDEQRKIIRAFRTRKAHLAREKYLQAVCEEVGIPVLKGRENSKKGDPRLEREFPRQGDSTVYNSALLRIMLLQGKKLEPWQVYKALHSAIQRRGFDKSVPWKNRPSNRKDSEEEDSKTAESASAYRQELIAAVGEDTQYQYPCYFAAYKMGLWDPKTHQLKQRINHHADTVRNYIIPRDLVVKELVDLLKAASRQFPRLEGREMRIIYGPSARAYASYYPDARAEYGLKEGGENDWQGLLGQKIPRFDNRLPAPCALIPRFNVARSNDIAIYEATFLMKLKNIRFYRDHLQNKDFNESSLTVAEIHQLLKEARQRAKEARQNGETEEHIAAAYSLNKTEWKKWLKKNCHAPISTHPCIEAPSTTGRSRYSRPAARLIRELVLSGQSPADFYKEAQDLCGKKGTPYYKLSKDDLVFLRYIKGEWQNIYIPVLPLSGDWSGKSTEMDLIREQIKKLIGAQRNVLVVHRIGLFYEQLERMISLYGVPDEIIMEFIREDFMGEEAKEKPKKFQNENRKAWDQARSQARELNLSGGGNVRKLRMLREQNFICPYTGDTLSENEVDTLEVEHIVPRARGGSDNQYNKVVTRSQTNREKGDHTPYEWLTQKGEFAAFCERVEKMGLSRKKKEILTAKDPFTLDQKWDSLAETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPKALLAETFYGTRELNGKDGGKTVVIRTKIMELGVTFNKFDQMKALREASSIIDPFLRDAVSTALKSRDFKINEWQEWCRNFRHPRTGARVLKVQITAQKPDTKEYVNMAKEGEEDGFRGQYKLGDQHQGYFIYLEKDKKENDVPKVRPVYAFHSRRKVEEE

SEQ ID NO: 292 - protein, 1045 aa, unidentified
  REGION 1..1045: note = Description of Unknown: uncultivated organism
  REGION 1..1045: note = MG1-298 effector
MTKIFAFDLGSGSIGECVREEGKSPIHLNSLLIDSDFASLDLIRAQRRAFRTRLAHKARESWWIQIAQEAGLPIPAADIKKDKFGHYVFTADEKMLREFPKTNDETVYNSALLRIALIEGKKLEGWQIFKAVWSAFQHRGYETNNWKDEELSEEEKKAEQEEQKASELYKEKLSVLPKEYQLPCYYEAYKMGLLNPQTKQIVTRLKTSTGNARNKDGRGEQIIAPRNIVEKELRLLLKQAKKQYAALPDTEYILYGTNRKAHAGLKDHSARKFESEGLLGQKTPRFDNRIIAKCSLIPRLNVCKSKEPLSREVRFLLALKNFRFIKNGQVSAFDFEEINELFNMYKGRLLDKVHANYIDKRDIKNYLKSKQYEIFSEDVIPMPKDGGRSRFCRPALRILKELILSGKNPHDFYRESTENITNTDTTKGLVKEDYKFLLAMPNDWYKIHIPDFREEDKNLSQEERLAKIDNLLNSITNAVVRHRLIMLMHRIEYLHKIYGVPDYCIMEIGRDEFLSEEEKADLNRANKERQKNNKKAYEELKKYGLEISHDNMEKYKLCESQKWTDIYNVFDDKKKISPEDLPNYDIDHIVPVSSGGADSLANKVVTARHLNQSQKSNKTPYQWLFEDKIKWADFLENIKNAGIDKNSKKYLFLTAKDAVSQAKSLNDLQATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKKPALRETVYALRARQEGKELKYYMVSRFNTRIDELFKKISDAKDNVKKIFDLSVKKAFEDKLNTNPSQEEWEQFLKDFRVSGNPVYKISMINSKGFKKQDVLNPDGSFKNPIGEYRAMGKVKGQYLMPKEGNKGQIIYNNGRKWVVEQIYPFDSIVKKLKAAKEKYGKVLFWNTGITLCLPNTIKGSLITKDENKKQQSIPTDVKVSKYKLNTIKGTTVIITDLSSGLKYSASLTTLIEEGKAYKERS

SEQ ID NO: 293 - protein, 1097 aa, unidentified
  REGION 1..1097: note = Description of Unknown: uncultivated organism
  REGION 1..1097: note = MG1-299 effector
MNSTETVFAFDCGLASLGEAVRQGQSFPLVESWLIPDKFAETKSAAMRRRMMTTRDAHKERELWLLKTFEDLGIEVLRGKEVSKTPAGWSVTRKADPRLTREFPKPGDDTCYTSCLLRIKLLRGEKLAPWQIYKAIRSAIQKRGYDPDIPWKNREEKQQKKEEESAAVLFDETLLRKTVGDHPDWLYPCFLDAFRMGLWSPANPTQLGTRIDHKAQSTRKTIMLRALVEKELRDLLHQAAQQLPALAGKEEFVLYGPNGKYSSSSVRAGALAQKVPRFDNRIIDKCALIPRLNVCKVRMEGTHPHPASQIIFEITFLQKLKNMRVQGSSGIRGLAPAEIALAAFSQKNSLPSKAWAAFCEERGLYPAPAFKKLAFKDVAPVLPPEVFRSALLEKLASVSVLDSGKRVRNLTDDERSALLALMQKPRDSFSFTSSQWANFCEDLGASPLPGHEEIKPPKAAGRARFCRPAAHILKRLILSGQAPATFHAAEILNLGGSADPRKGLVAADLDFLLNMGDSWDAIRIPDGKLDAIACQYTDADEAIRKLIGSQNNPVVRHRLGVFAQRLRELERRFGVPDQVVLEFVREDFMGDKARMELKKFQNDRAKARAEARERVAELGISEKNSLRYELWKAQGGRCLYTDDPLAETELDNYHVDHIVPRAKGGPDSRLNYVLTLNQTNDDKDDRTPFEWLSCNPARWLAYVNRVESRLKAADGISRKTAQLLTLPNAVELAEKYTALAETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEKAPLAETIYGLRKTPEGNQVVKRTDLRDLAYQTVNMKTVFNIDSAVKNGIPKILDERIQSALLEFARLKPTEEEWNRFVADFTPFGSRVRRVRLVETALPPDTMGEFKNMSKDGTAMLRKPLKANKGQYVFTEPDGKIKVRPVYSFESPFQVRTLLLAEEPGRVIQGFYQTGCLVSLERDVEAGKHKIPKGVYRLSTIRADAFVGIFNTHGNLLGPVGIQHLLRSGFRRIDG

SEQ ID NO: 294 - protein, 1059 aa, unidentified
  REGION 1..1059: note = Description of Unknown: uncultivated organism
  REGION 1..1059: note = MG1-300 effector
MRPTESVFAFDCGLASLGEAVRQDLAFPHVESWLIPEDFAETKSAAGRRRMLVTRQAHKEREAWLRMTFQDLGIETLNGKEVAKTPQGWQEVKKADERLTREFPKPGDDTCYTSCLLRIKLLRGEKLAPWQIFKAIRSAIQKRGYDPDIPWKNRETEKKEEDKEKPAVTYDAETLQKIIGSNESWLYPCYFEAHQMGLWSPERPDHLEARITHMAGSTRKTVMFRSLVEKEVRALLQAAALQIPALKGKEESILYGPDGKYSSSSVREGVLSQKVPRFDNRIIDKCALIPRMNVCKIRMDGTKPHPASRVIFEVTFLQKLKNMRVQSAAGIRGLTHEEIELATVLQKNSAAPKAWAEFCDSRGLTPSPSCKKLVFKETTPTLPPDQFRAAILEKLKSVSVMDGQKMIRDLTGDETLAALELFQKPRESLGFTAAQWTSFCEDLGVSSIPGHEEVKPPKASGRARFCRPAAFILKRLILSGQSPKDLHVAEIKSLNGNTEPNKGLVPSDLDFLLKMGDSWVNIHIPDGKLDAISQQSGSPDEAIRKLIGSQNNPVVRHRLSVFAQRLLSLASRFGTPDHVVLEFVREDFMGEEAKKRYLKFMNDRAKSRAEAREKVAALGISDKNILRYELWKSQGCRCLYTDLPLEETKLDDYKVDHIVPRAQGGPDSRLNYALTHNATNDEKDDRTPYEWLSGDSVKWQAYLNRVNARLKAADGISRKTAQLLTLPNAAELAEKYTALAETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEKSPLAETIYGTRSEDGVVQVVKRSDLRDLAYKTENMKTTFNMEFAKEKSIPRIVDERIRNALLHLVEKDLSEEEWNHAITQFAPFGSIVRRVKLIETTLSPGSMGEFKNMSKDGTPMLRKPKKANKGQFVYLEENGEIEVRPVYPFESTHQIKREILSGRKGRSIQGFYQTGCLVELTSEVRSGNTVIPPGVYR

SEQ ID NO: 295 - protein, 1098 aa, unidentified
  REGION 1..1098: note = Description of Unknown: uncultivated organism
  REGION 1..1098: note = MG1-301 effector
MKSKETVFAFDCGVASLGEAVRQGLDFPQVESWLIPDTFAETKTAAMRRRMMTTRDAHKEREMWLLNTFRDLGIEVLRGKEVSKTSAGWAVTRKADPRLTREFPKPGDDTCYTSCLLRIKLLRGEKLAPWQIYKAIRSATQKRGYDPDIPWKNREEKNQKKEEEETAAILFDEKLLRKTVGDNPDWLYPCYLDAFRMGLWNPARPNQLETRINHKAQSTRKTVMLRALVEKELRDLLRQAALQLPALAGREEFILYGPDGKYSSSSVRAGALSQKVPRFDNRIIDKCALIPRLNVCKIRMEGNHPHPASQIIFEITFLQKLKNMRVQGASDIRGLTPAEIALAAFSQKNALTPKVWASFCEDRGLHPAPAYKKLAFKDVSPVLPPETFRTALIEKLNAVSILDSNKRIRNLTEEEHAALLALFQKPRDSFSFSATQWSNFCEDLGVSPLPGHEEVKPPKAAGRARFCRPAAQILKRLILSGQAPAAFHAAEIHNLNGNVDPRKGLVASDLDFLLNMGDSWDAIRIPDGKLDAIANQCSSADEAIRKLIGSQNNPVVRHRLGVFSQRLRQLERRFGAPDHVVLEFVREDFMGEKARMELRNFQNRRAKARAEARERVAELGISEKNSLRYELFKAQGGRCLYTDDPLAETELDNYRVDHIVPRAKGGPDSRLNYALTLNQTNDDKGDRTPYEWLSGNPVRWQAYLNRVEARLKTTDGISRKTAQLLTLPNAVELAEKYTALAETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEKAPLAETIYGLRKTPKENQIVKRTDLRDLAYQTVNMKTVYNIDYAVKTSIPKIMDDRIKSALLEFAQSKPPEEDWNRFVAQFAPFGSLVRRVRLVETALPPDSMGEFKNMSKDGTPMLRKPLKANKGQYVFVEPDGKIKVRPVYSFESPFQVQAHLLADNAGRTIQGFYQTGCLVELAKDTEAGKHKIPKGVYRLSTIRADAYVGIFNTSGNLLGPIGIQHLLPSGFKRIDG

SEQ ID NO: 296 - protein, 1098 aa, unidentified
  REGION 1..1098: note = Description of Unknown: uncultivated organism
  REGION 1..1098: note = MG1-302 effector
MKTPETVFAFDCGLASLGEAVRQGLEFPQLESWLIPDTFAETQTAALRRRMMTTRAAHKERELWLQKTFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 297 - protein, 1098 aa, unidentified
  REGION 1..1098: note = Description of Unknown: uncultivated organism
  REGION 1..1098: note = MG1-303 effector
MKTPETVFAFDCGLASLGEAVRQGLEFPQLESWLIPDTFAETQTAALRRRMMTTRAAHKERELWLQKPFEDLGLEVLYGKEVSKTPAGWAVTREADPRLTREFPKPGDETWYTSCLLRIKLLRGEKLAPWQIYKAIRSAIQKRGYDPDIPWKNREEKQQQKEDKETAAVLFDEKLLRQTVGDNPEWLYPCYLDASRMGLWNPARPDQLETRQDHKAQSTRKTVMLRALVEKELRDLLRQAARQLPVLAGKEEFILYGPNGKYSSSAVRAGVLAQKVPRFDNRIIDKCALIPRLNVCKIRMADNRPHPASQIIFEITFLQKLKNMRVQGSGGIRGLTPAEIALATFSQKNALPPKAWTAFCEERGLHPDPAHKKLAFQDISPVLPPEAFRSALAAKLNGISIMDSGKRVRNLTEEERAALLALFQQPRDSYSFTSSKWADFCEDIGVASLPGHEEVKPPKAAGRARFCRPAAQILKRLILSGQAPAAFHAAEIRALNGNADPRQGLVASDLDFLLNMGDSWDAIRIPDGKLDAIASRCADADEAIRKLIGSQNNPVVRHRLGVFAQRLRELKRRFGEPDHVVLEFVREDFMGDKARKELQKFQNDRAKARAEARERVAELGISEKNSLRYELWKAQGGRCLYNDDPLAETDLDNYHVDHIVPRAKGGPDSRLNYALTLNQTNDDKGDRTPYEWLSGNPVRWQAYLNRVEARLKAADGISRKTAQLLTLPNAAELAEKYTALAETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEKAPLAETIYGLRKTPEGDQVVKRTDLRELAYQTVNMKTVYNIDYAVKTSIPKILDERIQSPLLEFARTKPTEEDWNRFVSGFAPFGSLVRRVRLAETALPPDSMGEFKNMSKDGTPMLRKRLKANKGQYVLVEPDGKILVRPVYSFESPFQVRAQLLAEKAGRTIQGFYQTGCLVELEKEVEAGKRILPKGIYRLSTVLADGRAWLFSHEGPLLPRLSLKPLLSAGFKRIDS

SEQ ID NO: 298 - protein, 941 aa, unidentified
  REGION 1..941: note = Description of Unknown: uncultivated organism with predicted taxonomy: Verrucomicrobia
  REGION 1..941: note = MG1-304 effector
VRNDKDNSLEGQKRTQVYQDILKRNEDRRETARKALRASSLPDSDEMVVRWLLYQEQGPFCIYSGQPIRCSELPNLQIEHIVPRALGGPDAYWNWVLCKTDQNVEKGNRVPYQWFHEEKKSGEWEDYRRRVRNRATWLGSRKVDLLLRADAKELVGEKYTALAATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYKQIKTARKANDFGEVDRLKHSIFPQRKRMAELFQSRDRLKQPRNIHKVRNWFREQLGGDRPVLPRPAAFKKVNIEATLYRCAYLIRNQTEPRRIPLPMLGRRPDFADDTQELFDLKWLRTRIQSITDADYDRAKLKALLGDRLKAAMSACLTHGHQFGEADWLAIVESKEVRELFSGKGRGKSKALPESADCQVKVFKVEMLPVKRYPLADLAYATGKTDVWNPVYFEDSISKILRRDESQPRGSRGKRRFQQIRPAPELPQGIASRWKGFFLDTDTQQKLKELQGEVAKIAALLPGPKPKKGETEKQNWEAADEKFGEALEEFRKKHDLPRKLFLFTSESDPPPKSPKTSLKRILFEPKDRIFSASVLKGQAADVVDLHFGRSLECFAESLLLVPDEQQRENLWKEFCNVVCIPTKKALQEFVAQKESISAKQWIDFFKSQDGPRVDQAEQEIGTLNEYCDLSKDGTGQFAKAGGMGGKPSYEGYFICKCKTDERIQAFPIRFFESKKTVRDRLNRSGWEMLDNSIWRSGELLHLKNKAVTKPKKQSQKPKEISSGYFMLGSIQKGTGVNLNACLGGEIPKAISLKILWDCGLRRASEPPHPSANV

SEQ ID NO: 299 - protein, 917 aa, unidentified
  REGION 1..917: note = Description of Unknown: uncultivated organism with predicted taxonomy: Verrucomicrobia bacterium IMCC26134
  REGION 1..917: note = MG1-305 effector
VFAFDCGVASLGEAVRRGLEFPQVESWLIPETFAETKTAAMRRRMMKTREAHTEREVWLLKTFEDLGIEVLCGKEVSKTPAGWTVTRKADSRLTREFPKPGDDTCYTSCLLRIKLLRGEKLAPWQIFKAIRSAIQKRGYDPDIPWKNREDAGQKKKDEESTAVLYDEHLLRKTVGDNPDWLYPCYLDAFRMGLWNPDRPEKLETRITHKAQSTRKTVMLRALVEKELRGLLRQAACQLPALAGKEEFILYGPDGKYSSSAVRAGALAQKVPRFDNRIIDKCALIPRLNVCKIRMEGNRPHPASQIIFETTFLQKLKNMRVQGSAGIRGLTAAEIALAAFTQRNSLPTKVWNAFCEERGLHPAPACKKLSFKDVSPALSPDVFRSALAEKLNGVAVMDSSKCVRNLTGEERASLLALFQKPRDSHSFTAAQWANFCEDLGVSPLPGHEEVKPPKASGRARFCRPAAQILKRLILSGQAPTTFHSAENRNIGVNADPRKGLVAADLDFLLNMGDSWDSLRIPDGKLDAIASQCSNADEAIRKLIGSQNNPVVRHRLGVFAQRLRELERRFGTPDQIVLEFVREDFMGDKARMELKKFQNDRAKARAEARERVAELGISEKNSLRYELWKAQGGRCLYMDDPLAETELDNYRIDHIVPRAKCGPDSRLNYALTLNQTNDDKGDRTPYEWLSGNPERWRAYLNRVEARLRAADGISRKTAQLLTLPNAVELAEKFTALAETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEKAPLAETIYGLRKTPEENQVVKRTDLRDLAYQTVDMKTVYKIDYAVKTGIPKIMDER

SEQ ID NO: 300 - protein, 1037 aa, unidentified
  REGION 1..1037: note = Description of Unknown: uncultivated organism with predicted taxonomy: Verrucomicrobia
  REGION 1..1037: note = MG1-306 effector
MTANETIWAFDLGKGSIGEAVRQGNKFLHKASLLIPADFAETKTAAGRRRMWRTRQAHKAREAWLDEVMRAAGIPVLQGRRVTWNEATKKWDVSLGDPRLEREFPAECDSTCYTSCLLRIKLLRGEKLEPWQIYKALHSAIQRRGYDPDIPWKNRAQRKAGTPDDDEAGTETRMKEFERRLEEMAPGKTEFQWPCYFDAKEMGLWHPAKPDELKLRQDCHAKTTRKQIVPRKLVEKEVRALVEAAAKFHPKLNGRADFILFGPAQRQYASFYADERKKHHLREGGANDWQGVLGQKIPRFDNRIIGKCVLIPRLNVCKIRTDDKGALLTQSRPAAEAVFLMKLKNMRLQCPGGQRGLTAKEIATIFTDPKRKKLGLTPTQWKNWCLLFGGKPLPGQYQEVKEPSFSGRSRFCRPALEILQRLILTGDTPQVAHDKERARLNGNTSPLKGLVPDDLMFLLKMGTTWEGIYIPNQKLDALAQSTDDPSETIRTLIGSQNDPIVRHRLTLFAERLNELAEKFGIPDAVVLEFVREDFMGKKAKIEYFKFQRDRAAQRAKAREEAAKAGAGEGAAGLKMELLEAQGGACLYTGEALAPTSLDDYVIDHIVPRAKGGPDSALNYVLTTRRANDDKADRTPHEWLSATNGWDAYVERVKKRTTALRNKKASLLVSPEAETLVQRYTALAETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFERPALAETIYGARHDHGEKVIVQRAELISLAYKPTAPGKSVFDLKYAGKQTQSIRDNSIREGLAEFLSSGPTEIQWREFCGKYCLKNKDGTDGSRVRFVNMTVGDPTEYKDLSKDGTGAYRKALKGHKGQIVYLDEKGKPRVRPIYAFESAAAAKTELLSRNPKFRICGLFQSGCLVELTKPIEHPTNPLLPGTYKLNTILADGRAKVTDKTGKMTLPMSLEKFLAAGMKRIES

SEQ ID NO: 301 - protein, 760 aa, unidentified
  REGION 1..760: note = Description of Unknown: uncultivated organism with predicted taxonomy: Verrucomicrobia bacterium IMCC26134
  REGION 1..760: note = MG1-307 effector
HGHLRSEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMR

SEQ ID NO: 302 - protein, 1129 aa, unidentified
  REGION 1..1129: note = Description of Unknown: uncultivated organism
  REGION 1..1129: note = MG1-308 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSRQNSMEKNLREYASNKANWRRGRGISYPRPQIEAHLRQIIERHKHLIKSHKKFTGVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 303 - protein, 892 aa, unidentified
  REGION 1..892: note = Description of Unknown: uncultivated organism
  REGION 1..892: note = MG1-309 effector
DELKLDSIRAWGKRGVLPEKYGNYLKLLIEDAGDFRGDKQAEALRIIDEAVARYRSDPIRTMLEEHLHERQHVNLRTPARGHNFPRELVKAHLREICERHRHFFPAEGFEEAMRELIGPVKNGAEEYDSKAESIMDWHRRTPGEARRLWERREGHCLLAPHLISTGLLPAGVYRRSPAGAGGIRRWKLVQFLAERRVELATGERTHVTADVVRQALDFVTADNAAVCERRRRPHAPKMPQAIEKAVGALASKKDSRLNADFFDQLGDLLKPSLSKLRGKAPLAEATAEALFQLATNGGANFEPEAIRARLNDSGYYDWRKHPGATRALYHQVDYLLGDARQYDPDTGEPKDHRDGAPRYHGLLRRLFAGQLRLDTGEIVDLRDRLDGRKVPDYVIIESVRDMPRNQDQSREIQKEQKERREERRHIAAIYGLDFDVLTEPQKRRLFLFHEQAGRDGEAVCPYTGESLGRDPLAADLEIEHIYPQRRGGLSIMENLAITRRATNAEKGNRTPVEWLGYEKAAEQASRMRWSKRKLEVFLWREERCPDWENLTRTAQLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRHPRSSRTTQQPVSLPDAEGRSWQRVAIRKTIHEKDGVVKTVEPENLLDAIRRAGLGPDRIADAEIERWKNDPRPIEQHPLRLRDGTPVHGLKIPIAQKKNEFGQYPHLTDAATAPDAPAYRSRDGRRQSRLIGIKGSTDTYDRLEIWRGPDLDRRGERRLDAKGQPKWKYFSFPVPGPRNLAAYRRM

SEQ ID NO: 304 - protein, 1205 aa, unidentified
  REGION 1..1205: note = Description of Unknown: uncultivated organism
  REGION 1..1205: note = MG1-310 effector
MNEYILREPDRKPLAEEWLNHEFYRSAVVLGIDIGLEGIGVYLRRGPQEIFARSIMLELPEAEALAERRQKRAWRHCRKNRKRRLHRLKLLFAKHGLPWLDADRISRAHPFRERYRAINNGVASKEALSICIRHCVVHRGYDYGGTEEGTFPWGESPLLSKAAEWLATAYVTPELKEQIEQLAPGLVPGKNEEEQRNKFAELLRERLEWSQQHDIARVLAEHVKGGHDNLRTRARGYNFPRQKVWEHLETIVRKHAHLIDDVEGFLAVLGLNPNRAANAKEAAKARKRAIFFYNRKTRFDMERHWEKKVNRCPFAGKLGGNPDERCAENGDLNVRRWKALEFATTRRVEIEATEGKGATKKKRRCLHSLSASATRKLIEFIEKHHGAASPATAPKWEEGKAIILDDITAVHGEKAKPVAEKQSEWNKSYFTQLKDLLTPTIANRKKRASLSAFAAGQLFNIATADGSDFTPENVVARLREARFYDWRRNASVDFNPFPQVELLLGRRIKHGKRRGELSPTCQGLLRRIFAEHREALGGATAPDYCVIEVIGDPPRNAQQRAERQKEIEANREKHEKLFEQYGIEDSGVASKRRRIMLYEQQRGKCPYTGKDLPSNPLDPSLEIEHIFPAEMGGLSVDDNLVLTWRSVNAEKGKRTPLQWAGERFDAMLANTRDMRWSARKREIFAWGTIREDKPDKPSHYNADGTLRVPDFGNTTRTAQLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQSKTQSLGDSTFWKQVRPTEATVAQRTALDADSLTKLRIVDGESLHAHLCRMGIQATKIPNRDALQKWLDEATAATKADKDKPIAPLKLTDGTPVKNLWKFDSKGSFSSPVGWSGKRNPDGKLRELRTISLKYDRLELWLGYDHQKAERARRAKQPDWEQAGWVYQKRLIPDARALRHVKQMGFSFARDKRHKAPAFMQNKPDKPETHQTLRDLVLGGRLLPFSHKVGEIRKGDVFKLHLLPDGSIRKRTPVGQPEPAAALSTFYVVTALKHGRGNPVVELTSQLFKDKEGTPMERFAGDVLSKILSTADDLAYVLGLPPAAEEAQKHGWRIPTSPPPPAAAAKETDGNLL

SEQ ID NO: 305 - protein, 1231 aa, unidentified
  REGION 1..1231: note = Description of Unknown: uncultivated organism
  REGION 1..1231: note = MG1-311 effector
MNELISPNTAWKTQSEYWLQHEFYRTAVVLGIDIGLEGIGLYLRKGPQEIFARSLILDLPQAEALAERRAKRAWRHCRKNRKRRLHRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPPLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELKATLQRMRVDWNKQKQQTESKIPSRDALQDWLDAATPTTKADKNRPIPTLKLTDGTPIKSMWKIDSKGSLTSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 306 - protein, 923 aa, unidentified
  REGION 1..923: note = Description of Unknown: uncultivated organism
  REGION 1..923: note = MG1-312 effector
MERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKKHGQLAESCQGWLRRIFADQSEALDGCTAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLSVRDLVLGGRLLPFSCRVGAIKKGDEFLLHLLPDGSVRKRTPGGEAEPAAAFSTFYAVTALSHEGGNPRVELKSRLFKEKEGTPLERFPGDLTTRKVAVSSDLAFLLGLPPAWIAAQQRGLRPPSPQIEHAKTTTERNSRDPNPRLL

SEQ ID NO: 307 - protein, 1129 aa, unidentified
  REGION 1..1129: note = Description of Unknown: uncultivated organism
  REGION 1..1129: note = MG1-314 effector
MKMTQKQANNVFQRETVITKWQGAPFYTKDVVLGIDIGIEGIGIAVRRGPELLYCKTLMMKLPEQAPLEARRVLRSSRRARKSRRVRMNRLKQLFQKHGLPWVDDEIMARSDPFLLRDRAVNKNGLASKEALSICIRHLVAHRGYDFYAFLSDGEAPWGECSDFKAAKKWLSSTFVSEDIQEELLQDAENFFAEKDLEVWKALVQERLDWSLQNSMEKNLREYASNKANWRRGRGISYPRPQIEAHLRQIIERHKHLIKSHKKFTDVLFKKCDDDNKDICIFHYNRKTKEECEKVYERKIRTCPFAKYWDGAAQKCASRGDHAVRKWNLLDFLSNRRFRFAEGSIQIMRTMPEDCVKLLIDSLEESFDQKLTWSDHKQKLVESLKQHGLKIANPPKELSGKAKKSDAWKQLQDLLAPGKPLTSRAKLSSESAQKLFDTTTRNGTSFDPAQISARKKEMDYYEILSHTSMDYGVYPQVQKLLGTLRKPKAGEAPSFGTKGFLQRLFETELKDQLKRKTVPDRCIIECIKDPPRNKKEQDARASLNVENREFIENLLKDYGYEGAHSRSLINRLKLYRQQGGEAKDGQVTKEAVCPFTGMPLGKNPLSSDLDLAHLFPDGRGGLAIEDNLVLTKRSVNQDMGQRTPREVAGTRMGKTSFLSWNEMLARSKSFKWNDKKRELFAFEPAKGQPVPDFENLTRTAQLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSKSKCKPLGDSTFWSVDEKGETWQRTTLIPLDKDALKDFTPEKIREKLAAEGIKESDIPGDRKLEAWLQNPKYSLHLKHGQPVRFVHKKGNKGDFRNPVGWSGIRHPNGKIDQLRKLDLVNDRLELWVGYDPKKGWQYYKRVIPSKDSMRGLKRLGIPWHGQEGLSEYTKKLINEENCKDLKEFYCGTLPQYSHKVGEFKLGDTFLIDVSKKKQKKQNAEGTEIFKDTPIPNSKEWFRVSAIILFREKGKKGIKRKVEFKPIITKGDSFTKEIACDLAQLLGKPKSPEKCAQQNGWKAPSNKKG

SEQ ID NO: 308 - protein, 953 aa, unidentified
  REGION 1..953: note = Description of Unknown: uncultivated organism with predicted taxonomy: Verrucomicrobia bacterium
  REGION 1..953: note = MG1-315 effector
AGASKKERLPHAAPPRRKAIFFYNRKSRPEMERHWATKVNECPYAHRLDPGLAGTKITCGENGELPIRKWSALEFSATRRVEMETIFGKGKEKRIRRSLHSLSGRVVGKILETIERHDRALNSGDKAAAPSWDEVKAIIEDDLRTLADAKVKLATSKKGDWNETFLAQLRNLTLPSLANRKQRASLSALAAERLFALATHDASDIDPAQFAPRLKAIGFYDWRRAATVDFNPYRQVEVLLGRRIKRGKKRGQLAESCQGLLRRIFAEHSEALDSSAAPDYCVIEVIGDAPRTTKQAQEIKFAQDERGQKRRELFAARNLEDSGVASKRRRISLWDQQKGVCPYTGNELPKDPLDPSLELEHIFPAEMGGLSTDENLVLTSRTVNSDKGKHTPLQFANKLRVPFDQLVAHTQDMRWSAKKREIFAWGTLREDKDDQKSHYLPDGVSLRVPDFGNTTRTAQLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQSKTQSLGDATFWRQVRQGEPALAQRTALNPENITDADELHATLQRMRVDWNKQKQQTENKIPSRDALQNWLDTATPATKADKHKPIPPLKLTDGTPIKSLWKFDSKGSLSSPVGWSGKRNLDGKLRELRSISLKYDRLELWLGYDHKQAERAHKSNTPDWEQSGWVYQKRLIPDARALRHLKQMGFSFGRDKRRKAPAFMQDKPDKPETHLSLRDLVLGGRLLPFSCNVGAIKKGDEFLLHLLPDGSVRKRTPAGQAEPAAAFATFYAVTALSHEGGNLRVELKSRLFKEKEGTPLERFPGDLTTRKVTVSADLAFLLGLPPAAVAAQHHGLRPPPPRIEHPKATTEMIPRDANPRLL

SEQ ID NO: 309 - protein, 993 aa, unidentified
  REGION 1..993: note = Description of Unknown: uncultivated organism with predicted taxonomy: Thiorhodospira sibirica
  REGION 1..993: note = MG1-316 effector
GPGLDALEPFRKDRKTGAWIPQHTLRRDSLFFKEWQSEVALRNFRVKRRLITVGRSKKEKFELIPPPPVALERLRNLWNEHGHLWAEDLREWAKNYEGQFELRDPDFNLTPRNDFSGRARFSKNGMAAIRQIIANAREKHDAAYNTWEQRFKDKNLKANEEDIANGYARFLTQLTNEAASNQATADNSYARTVAPPPVLILPGETTDGAFQRYLNSIRNPQVRHRVELFGRELQRLMNLHSEDQAPDFIIIEMARDLMMNQKQKDAKEAKDRERRDERDKAAQILRDMGYAPTADNIKKFLLAQEVGWRCPFTLQAFCQSDFSRLTITQLAQAENKPRFLKEASSVFRRLEVEHLVPRTPVVCNEWYNLTVTLHSTNAQKGKRTPFQWLSIDKDGVPPDLDWDCACKNAADRFGANSLKYQIFTSPNAAEIIADNAKRSIQQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNAQAFDTTPYGRREKFGGDELGQPLFVARKRILDLKTSHLNPRNTGGFIFSPLIRDHIAKEWESFSGNEKNWIRIESDWIAIFEAQIATLRASGKDDQKTRLGIKARESRIYKLRQMEGCKDWEELLSFIAKELGAQQPQPKFPSQFIETLCHPIYKTPITSVKVTAQSKNDESFSLVRRPTSEKARSGTYVMRKQEDKYREMRVYRLPKPGRSGAYACWLLLPWYGMLDARGKRFKTVEKDLMTRACKGAKFVRAFRRDDIVCFANNLLANKGIKQNESWRIVRTDAKGDCLANVGLLPANLARETSHPITGEKVKLEPVVVALNDFMNALEPRLPTDELSHSPPVKPKSPGAAET

SEQ ID NO: 310 - protein, 1119 aa, unidentified
  REGION 1..1119: note = Description of Unknown: uncultivated organism
  REGION 1..1119: note = MG1-317 effector
AERMSRSLPFRERHRAVNKGVASKEALSICIRHCVEHRGYDYGGTEEGAFPWGDSPLLSKAAAWLSTAYVTPDLADKLQDIEPQLQAGRKEEEQREHFLYLLRDRLAWSGENDIARVLADHSQGGHDNLRTRARGHNFPRTKVWEHLEGIIRRHAHLRADVEGLLAVLGLDPNREPDAKRAVKAKRRAIFFYNRKTRLEMERHWAKKVNICPFAAKLGLDHPEERCAENGDVNIRRWKLLEFAATRRLEIDVAEGKGATKKRRSLLHRLSADAIRKLVETVQKHHAAVVASNRDAEPKWDESKDTILEDITTAWGERAKPIPETKSDWNKSYFSQLKDLLVPTLSNRKQRAALSAASAVRLFDLASADGMSFTPEEVIERLRKAGFYDWRRDASVDFNPYPQVEVLLGRRIKRGAKRGHLSETCQGLLRRIFAEHEEQLEGKTAPDYCVIEVIGDPPRNALQRAERDQEMKERREKRNKLFEQHHLDDSGVASRRRRVTLWEQQKGKCPFTGKELPANPLDPSLELEHIFPEDMGGLSVEENLALTWRTVNADKGKRTPLQFAAKLGVPFDQLMAHTQEMRWSAKKREIFAWGAIKEDRGDQASHYNPDGALRIPDFGNITRMAQLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQSKTQSLGDATFWRQVSPVEGTLAQRTVLNPEKITDADELHATLQRMRVDWNKKQQQTENKIPNRDALQAWLDAATPATRADKDKPVPPLKLTDGTPIKNLWKFDSKGSLSSPVGWSGKRNADGRLRELRSISLKYDRLELWLGYDHQKAERARKAKTPDWEQAGWVYQKRLIPDSRALRHLKQMGFSFGRDKRRKAPAFMQAKPDQPETHLTVRDLVLGGRLLPFSCKVGAIKKGDEFLLHLLPDGSIRKRTPAGQPEPSSAYSTFYAVTALSHEGGNPRVELKSRLFKEKQGTPLERFPGDLITRKVAVPSDLAFLLGLPPAGMAAQQRGLRLPPPQIEQITTTTEMNSRDPNPGLL

SEQ ID NO: 311 - protein, 1000 aa, unidentified
  REGION 1..1000: note = Description of Unknown: uncultivated organism
  REGION 1..1000: note = MG1-318 effector
HRLQLLFAKYRLSWLPAERMSRSNPFKERLRAVTTGVASREALSICLRSCVAHRGFDYGGTEEGQYPWGGSSKLSDATQWLHTAVVTNELKDLIEDKLDELEADKSPEERRAAFRDLLRERLDWSLHHDIEMILREHAKGGHDNLRPRARGVNFPRKEVWKHIEKIVRHPRHREFLPDPEAFLKELGIDPNKAGGASPKERLANAARARRKAIFFYNRKAYPEMERHWAKKVNDCPYGQRLDPGLQGSKITCGEKGELPIRKWSALEFSATRRVEMETIFGKGKEKTIRRSLHSLSGGAVGKILKAIEQHDRALKSGDKSAAPSWDEVKAMLVEDLPTLANAKVKLATSKKGDWNETFLEQLRNLTLPSLANRKQRASLSALAAERLFALATQDGRDIDPAQFAPRLKAIGFYDWRRAATVDFNPYRQVEVLLGRRIKRGKQRGQLAESCQGLLRRIFAEHHEALDGSAAPDYCVIEVIGDAPRTSRQAQEIKSAQDERGQKRRELFAAHNLEDSGIASKRRRISLWDQQKGVCPYTGKELPKDPLDPALELEHIFPAEMGGLSTDENLVLTWRTVNGDKGKHTPLQFASKLGVPFDQLVAHTKEMRWSGKKREIFAWGTLREAKDDQKSHYLPDGVTLRVPDFGKTTRTAQLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQSKTQSLGDATFWRQVRQGEPTLAQRTVLNPENITDADELHATLQRMRVDWNKQKQQTESKIPSRDALQDWLDAATPTTKADKNRPIPTLKLTDGTPIKSLWKFDSKGSLSSPVGWSGKRNADGKLRELRSISLKYDRLELWLGYDHREAERARKSKTLDWEQSGWVYQKRLIPDARALRHLKQMGFSFGRDKRRKAPAFMQGKPDKPETHLS

SEQ ID NO: 312 - protein, 1078 aa, unidentified
  REGION 1..1078: note = Description of Unknown: uncultivated organism with predicted taxonomy: Verrucomicrobia bacterium IMCC26134
  REGION 1..1078: note = AKC83434.1 effector
MVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 313 - protein, 1078 aa, unidentified; identical to SEQ ID NO: 312
  REGION 1..1078: note = Description of Unknown: uncultivated organism with predicted taxonomy: Verrucomicrobia bacterium IMCC26134
  REGION 1..1078: note = AKC83434.1 effector

SEQ ID NO: 314 - protein, 862 aa, unidentified
  REGION 1..862: note = Description of Unknown: uncultivated organism with predicted taxonomy: Verrucomicrobia bacterium 61-8
  REGION 1..862: note = OJV06180.1 effector
MEAYVDELNAMSPLQLEFQLPSYFDAWKMGLWNPKNPTELKDRIDCHAQSTRNKIVPRWLVEKEIRLLAENAGKQIPELAGKSDYLLWGPTRRPYASYDCSVRKEFGLREGSVTDWQGVVGQKTPRFDNRIIEKCTLIPRLNVCKIKSDGKNPLPESRIVFETTFLMKLKNMRVQQGPTEQRGLSAAEINAIFKDEKFRSFKITEAQWNKLCISMGVRPQPGYETVDPPRSGGRSRFCRTSLEILKRLILSGKNPPEFLEEELRRLNGNTDPKRGLIADDLKFIEKMGSTWEEIHIPNQRLEAILQLAGGADAAVRQIIGSQTDPIVRHRLDIFYQRLQSLREAYGTPKSVVIEFVREDFMGKKAVIEYRAFLKKREAERKRAREDAAKTGSTERSAALKLELLREQGGICLYTGSALKETALEQYEIDHIVPRSKGGPDAVINYVLTLRSANDEKGDRTPFEWLSRTNQWDAYVQRVDSRGTVLRNKKTKLLLNENASELAERYTALAETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEKPTLTETIYGARRGDQGLVIVQRAKIVDLAYRSITPSKSVYDLTYAAKQFKAIRDAHIRRLLEDFLKRNPTEQDWQEFCASFALPRRDGTLGSRVAQVTMNIGSASEYKDLSKDESGSWRRGKRHRGQIVYLTDGKPKVKPIYAFESEQEALKELLLSGAKIVGIFRSTCAVRLTEAVTHPKTPLVAGLYVLNTIREDAFAVLTDRSGARSQPISLNKLLAAGFQRVESLEI

SEQ ID NO: 315 - protein, 862 aa, unidentified; identical to SEQ ID NO: 314
  REGION 1..862: note = Description of Unknown: uncultivated organism with predicted taxonomy: Verrucomicrobia bacterium 61-8
  REGION 1..862: note = OJV06180.1 effector

SEQ ID NO: 316 - protein, 1324 aa, unidentified
  REGION 1..1324: note = Description of Unknown: uncultivated organism with predicted taxonomy: Pedosphaera sp. Tous-C6FEB
  REGION 1..1324: note = PAW75411.1 effector
MLRPCVRKDRLTVLCRPPGRLPSRREFLRLDQPRRAEGQLGIVTSDPCPCAGGKHLICRKAAGNNGSMSAKDYVLRGAVPMDSTLMPNHIWAFDLGKGSEGEAVRHGTDFPHVESLLIPAELARRGPAATSGTPANKYRALKTREAHRARERWLETVWTAAGFTPLHGRQVAKVCSLPVKLDENGEPKFDKGHWAQVAKGDYRLEMEFAPKLGTKTKDGAPSDLAGADICYTSCLLRIKLLTWKESGPKVADWQIYKALRSALQTRGYGRVPWAAKESQREQQTKEEEAKETETATRWAEFKQSVAPEFRFPCYYDAAKMGLWNPAAPNEPTPQNSHLANSTRNVRFDRADVECEIKQLAENADRILEGRLSLAKEKLVQEFMEGRRKRVREINERRALKNLTLPPDKRKQPRKDPAFQRISASVADFFCYGPSGVSCASYDRSLQADLALRAGSAYDWQGALGQKVPRFDNRILNDCVLIPRFHVCKVDVRVAEKDDDKQGVKAGQVFADSLLATEVTFLLKLKNVLVADLEKGQRKLKAHEVRAIFEYAHRQLQSLKLLSQDGGLVKNWPGKVADCFALTKSEWGNKKKGIGLLGLRPLAGHEEVKAPKTGGRSAYSRAALRILKELILSGEAPSVFHARLLKREPELLGRLGSSLAKPLALHADSTAQDAEQSKREDTEHRKCGLLVSELKFLLQMRKEDGQPDSWENLFAPSQTLDALKGRHTTDGKLDSEAAIRELLGTINDPIVRHRLGVFAGRLKKLQFGDAKENIQAFGVPDAIVLEFVREDFMGEKALAELQDFQRRREADRKEAKEMAAAAGATSSLSALKYQLWKAQGGECLYGKEVFNESGVSKAQCLYRGTALPFTKLDDYVIDHIVPRAKGGPDAMVNYVLTTHETNEAKGDRTPFEWLRSAPDWDAYNKRVAARAHTLRNKKVQLLTREDAPELVQRYTALAETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYERSGLADTAYGRRTDGEKCVVVQRTPLRGLAYKQVKMKSVFSLEYAATQVAAIRDGRIQAEMKRVIAAQPNEAQWRAICDALENGTHSGFEGVRVVKVTVNRNEDPAEFKDLSKDGTGALRMRKKEHQGQFVFLDSKGRPRVEVVRVFDSLRDVKARLAKEHAGLKEVGFFQSMCQVELDQPVKHGNCTLLPGTYLLNTIKQDGRAQLTSAGGDKSPEIGLVKLLPAGFRRKA

SEQ ID NO: 317 - protein, 1324 aa, unidentified; identical to SEQ ID NO: 316
  REGION 1..1324: note = Description of Unknown: uncultivated organism with predicted taxonomy: Pedosphaera sp. Tous-C6FEB
  REGION 1..1324: note = PAW75411.1 effector

SEQ ID NO: 318 - protein, 1086 aa, unidentified
  REGION 1..1086: note = Description of Unknown: uncultivated organism with predicted taxonomy: Verrucomicrobia bacterium IMCC26134
  REGION 1..1086: note = WP_082083265.1 effector
MSQVTGLPLVLAFDLGKGSIGEAVRLGNDFVHVASWLIPQDLAARGPSAKPGTPASRYRAWRTRVAHRERENALRRICADAGIEVLAAKRVARDAADKKKWIVVSKADERLTREFPKKGDSTCYNSALLRIQLLRGVKLEGWQVFKALHAAIQRRGYDNAVPWKHRAVRDTETEEDGITQQRADSYCLALEQMAPNKPECQLPSYLDAHRLGLWDASRPDEYILRIDHHVAPARNREHPDNTPIVAPRELVIKETRALLTAAAKFFPKLAGREDEILFGRGGKAYASYFDDVRRAHSLRLGGANDWDGILGQKVPRFDNRIIAKCALIPRLNVCKATTRKDKTGAIISESLLPSEVTFLFKLKNVRVQRPDKSITGLKPDEIRTLFNDPKREPEKLSYTKKQWSKEIARFGCEAAAGHEEIAAPSFGGRSRFCRPALEILKKLILSGESPATAHSRELAERVKGNTNPQQGLVVSDLDFLSPARIGETWDGIHVADQQHGALLRLAAEQGPEVAIRALIGKVNNPVVRHRLEAFWGRLRAIEADLKKRFGRGPDEIAIEFIRTDFMGPKAKLALAKFQSERAEAREDARAQVGKIGADGRASPLKYELWKAQGGICLFVGESLAPTDIESLEIEHIVPRSQGGSDAFINYVVTTKATNKLKDNRTPYAWFEANGFTGWDAYVKRVEACATALRNKKVRLLTAPDAIELVERYTALAETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYERSELEATAFGQRTLGGKLYGVARVDFCNLVVKVALNGNRSLNIKPDGSGEADTIVDQAIRRDVQAFIDQNRATITLAIWDAWVSSYHRGGSNGPLVKKVLVTITNPDSLEEYADLAKDQSGQLRRGKKHKGYWILRILSPTKKDPTKTTLQVRPIYAHANPHALKAEIGEDHGCEIILELESGCLVQIDKPIAHAKTPLAAGIYKLNSVWTQGNVVVSSQSGVTSAPIGLAKFIEAGLRRLK

SEQ ID NO: 319 - protein, 1086 aa, unidentified; identical to SEQ ID NO: 318
  REGION 1..1086: note = Description of Unknown: uncultivated organism with predicted taxonomy: Verrucomicrobia bacterium IMCC26134
  REGION 1..1086: note = WP_082083265.1 effector

SEQ ID NO: 320 - protein, 1333 aa, unidentified
  REGION 1..1333: note = Description of Unknown: uncultivated organism
  REGION 1..1333: note = MG2-1 effector
MPTTNPYVITHVTKNWMKDEFYDSALVLGLDIGIEGIGVWLRKGREPLFARTFMVSLPEAAPLKNRRAKRAQRHARQSLRRREAMLREWVVRYGLLPQEKTDGRWWKNPAVFERAFEHRHRAITTGVASPECLVVCIRHLLRHRGFDYHLTDEGAFPWGDELDDKEIIQWAKNSCCAPEYRTHLCNLIEADAAWAKNSDGSFTEKYLKVRQALDDAVREYENRPVERMLEQHMSEKNHPHLRPRARGRNFARELVKQHLYAICEKHRHFFAPGTFDQAMRELLGDQTGPSQWKLTWMDQDGKARQTILDYHRRTREEAEELWKRKVKKCPFAPLLFEKRHPTTPQHDCAVRSDPRIRRFNLLMFLAERRIELETHDAEGRLQNPRVNLDANVVRDLLGDLEQDIRAVEALRNKQSASRPDKPGKKTFEQRWRICNDCGKETGQDETGKSSCCKAKTKPKMPLAGVAKGSFNADFFDQLGDLLRPELRSLKGRASLSGEAAEVLFKLVTRNGTDFEPARIRQALEDCGYYDWRTNLPAGLGIYPQVTFLLGNRGHYDKDGNPRQIDKTTGNPVHHGILRRLFAGQLRLDDGTLVGLKDKLDDKVVPDYVVIETIGEIPKNQKEKKEFQDEIKANRSRKTDIIEKKYGLKLDSLSDWQVKQVLLFDQQANEEGEAFSPYSGVSLGTNPLAHDLEVEHIYPERRGGISVMDNLVITWRTENQTKGDRTPWEWAKDEGWRVDVHLQKMHWSANKRALFVRQESDPPQWDNTTRMAQLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRKSKKSRYKETIFSLPDQQNRVFAREPLSKVVTSLLKSKKKNPDAELRKLLDRPGLLNPLEITNKKTGQTKQIKLLNKADVERWLSCKDVSLDQEGFRKFIEDVGVPTEQIPDDAVKAAFMKRNGETLLRKTFKPNSLVSFIRQKCRIKDSEIEARVEIAIAERNERTVLRAANGRDGQPGQVIRSILIEQDKLPPCGFGLHFNPTAKPKRGSEVAGFKPVDNSNSVVYLRREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNGTIEFQMAEFAEPKLVKGQIPDPATERLLETYELTCSNEADLLWLLEVTTGKRIKLPPPVVENAPTTGKREGELL

SEQ ID NO: 321 - protein, 1080 aa, unidentified
  REGION 1..1080: note = Description of Unknown: uncultivated organism
  REGION 1..1080: note = MG2-7 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGTVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 322 - protein, 1471 aa, unidentified
  REGION 1..1471: note = Description of Unknown: uncultivated organism
  REGION 1..1471: note = MG2-3 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNTDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 323 - protein, 1196 aa, unidentified
  REGION 1..1196: note = Description of Unknown: uncultivated organism with predicted taxonomy: Verrucomicrobia
  REGION 1..1196: note = MG2-5 effector
MNNKMKIPTMKIAASKADLQLAFDVGHSSLGWAVLQTTPEKASSIELLGCGVVTFRADDCLASARRGYRRQRRHIRSTRQRIKRMKTLLIHLGVLTKAQLDQPGCAWPWLLAARVLHGGKLLSWPELWDVLRWYAHNRGYDGNRRWTKQEVTPDESTDFDDSELERILSDATATEDEKSDAEKVKEAKILMRSHGVKTMAETFCAICGLDPLGQKKSCNLPGDKRPKAMNAAFPRAVVEGEVRRIMRAHFGGKLPKVDEALERMLLGLNSQDKVAWRAIPCPGLKLPKRYQGALLFGQLVPRFDNRIIATCPITHYQEYQRALGAIRDNDPAYLKKHSVNLDNHDPSWWAKHIADKLAKVPSRDCVEFMNFRWGMQLANIRVARFGEKELSPLKVEERKQLDDMMRAAGAMGPGEFKKSVRHVTSAIRDNLDTMLMHPDAKDALVLDAVQKLIRSDDLESIWKLLPERLQKRTRGRWRQGWRISFADLRRQLAELGGDTEAFDAELTRQVDAANVNLKKKGKQTTREELLKKPFFVKKLGQRAAFARHLLKQAYEEVMAGSHPKEKDGCLFISEEMREAQLQREIAQQTNNHLVRHRLLILTGNEKAKPHPKEGLLQHIIKEYAGGDGTRIGKITIEVNRDLREMSGKSNYDKQADLNNRVKNHHSVVEYLHEHLPAKYHNRINGSLIRKARVAADLDWKCPYTNEAIQPIHLITKVVDLDHVVPHALRPSDGLDSLVVTFCAVNKMKGKRTAWQFIKDEETRSVSYRNEQGKEEKVDGMPNLKIRFFSDYKKFVDDLKIKAKGEHKADAERRERRQQLLRLANYEEKAFLPRDLTQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIPARMDGLRVEQNMWRVVSVKDGEATLRQRIRHVDGSRPKKAGTEKKTKLLGLEPGKLQTNKGVLIIPDNFGVALVQPEPVIVPFHKVWVRLRDLKKVNSGTKPEIIRNGQIIRIAEGKYKGVWRVFSAKNNSTGMALDIGLPDVVRLKNKTEGHKINVLLSSLVKNGIEAIKAPLTGVPVSAGKGESHSSPLEPRQSSNAS

SEQ ID NO: 324 - protein, 1119 aa, unidentified
  REGION 1..1119: note = Description of Unknown: uncultivated organism with predicted taxonomy: Verrucomicrobia bacterium
  REGION 1..1119: note = MG2-6 effector
MQVENFLNKVENRELEVAFDVGHSSIGWAVLSRKTSQESQNVAEYFYPEIIGCGVVIFEPDTCLAKKRRDYRRQRRHIRSTRQRIKRMKSLLQHLGVLTEAELDKPGNSSPWKLAAKVLQNSGLLTWQELWDVLRWYAHNRGYDENRLWSETLPDDEKEESKRVENARKLMAQFQCGSMAETVCKMLGVDPLSTDKRSSHLRYKGTDIAFPRNVVVREVREILKKHIGKLPQVSEQLVETLTGDKENSWKTIPCPSINLPKRYYGSLLFGQLLPRFNNRNIARCPISGEKLPLKECVEFYRYRWAMLLCNIRVKVNGSKERPLNVNEREYINGIMEKKGFFTKHELRIAVNDAVMQTLKNENYNGTPVILTNISAMFLTEDMEKALTLYPVKKIINSEKVQVFWNIIPERLQKRISGLWRKGKQITPQEFRNQLEKISPEKLLDFDNAVEEFLKKNRKEKNYLESKIPDSPLKDLQGRAPFSKAILKKAYEEVLSGRDPREEGGCLFRSEEIRLRELNKKITEQTNNHLIRHRLLILERLFDDIVKEYANNDKNRIGQVTIEVNRDLREFSGMTAKEIASELTKITSDHRKAVQYLEENLKGKPYKITASLIRKTRIAMDLDWTCPYTGQKYDIYDLLEKRVDLDHIIPQSIRPSNSLESLVITFPEVNRFKAQRLAFQFVKEEQTKTVKGLPNLQIRTLENYKNWGENLKESRFDRNKSPQSKRKKLLLLPEYVQEEFLPRDLTQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHISKDMSGLKCDETVWRVVDQNCDNSYGKKLLRWCKEMNVEIPAPDSDSVLIVSRKRKDKGTTKPTKILHESQSFWWQYDIVKKSKVIGLNPENGDGKLKKLKAVKIIGDNWGLALDPKPQIIRAFKIYQQVREIKNANDGKPPRIIRKGQLIYVPNGRYKGLWKVFSVKDKKTGIYLDIGEVDQVSLRSERKSAKENVDVRTLMKNGLRPLSTPYTGINACLIT

SEQ ID NO: 325 - protein, 1056 aa, unidentified
  REGION 1..1056: note = Description of Unknown: uncultivated organism with predicted taxonomy: Verrucomicrobia
  REGION 1..1056: note = MG2-8 effector
MASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 326 - protein, 985 aa, unidentified
  REGION 1..985: note = Description of Unknown: uncultivated organism with predicted taxonomy: Verrucomicrobia
  REGION 1..985: note = MG2-10 effector
MKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 327 - protein, 952 aa, unidentified
  REGION 1..952: note = Description of Unknown: uncultivated organism
  REGION 1..952: note = MG2-11 effector
WTAADIETLKEDTEKEENAINLMQKNGLTTMAETFCKELGIDPLGSKKSSIVRFKGFNAAFPRKTVEDEVRRILRAHFNKLEKANADLERALLGRDRNDKLAWQAIPCPNLKLPARYQGGLLFGQLIPRFDNRIIVRCPITGQKVPTRHCAEFLNFRWGMQLANIRVACGGERWLHPLNVEERKAIDARMREQGSMTEGELKKAVRTNTGCSRDNLDTMLMHPDAKGALLLDPVRKLTKSEKLKTLWPLLPEPVQRRAANMWRRGKAITLLALRDRIETAGSSPAAFDAEVERLLDAANTKKRRKDQPITREELLAEPLVVRPLDGRAAYARRILRQAFEEVMAGKHPTKEGGCLFRSEEIRAAQLQCRVDEQTNNHLVRHRLLILERLQSDIIKEYANRDPARIGRATIEVNRDLREISGKTAKEKAQELGQRLANFKSVTKKLEEAFEGRNVHISPGLIRKARVAEDLGWTCPYTGQRYDPLDLLNAKVDKDHVIPRTERASDSLDSLVITFPAVNKWKDKRTALKFIEDEQGQPVLDMPNLSIKTFAQYEADVKALRPSFDPRPAKRDGRTKGPIDDDLRRWNRKQLLLNVRKWEEKEFLPRDLTQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVPSEMTGLRTEENSWRVVGIENGEALLRQRIRQPDGSRPVKEMRERTEKLIGPEPRNRTGKLKRNKAALIISDNYGVALDPEPTIIPFHNVWKRLAELKQANGGRPPRVLRNGQLIVVPNGKFKGAWKVFSAKNNKSGMALDIGWPDVVRLRNKVEGHKINVLLASLLRSEMRLAKTPLTGMAACPSTSSA

SEQ ID NO: 328 - protein, 829 aa, unidentified
  REGION 1..829: note = Description of Unknown: uncultivated organism with predicted taxonomy: Verrucomicrobia bacterium
  REGION 1..829: note = MG2-12 effector
MNAKRKNEVAGGTKPDLQLAFDVGHSSLGWAVLQTGEANSFEVSLLGCGVVTFGADDCLASQRRAYRRQRRHSRSTRQRIVRMEKLLLYLKLIEPQQLATKHQQAGGHPAPWLLAARILASNGDPRYLLDWPELWDVIRWYAHNRGYDGNARWANACDRALSDAEQEEKKADTEKEKKADELMENYGKKTMAETVFADLFAPFHLNDPTKVSSLPFFQRRFKANQCAFSRETVEAEVARLLDAHTGNLKGCNKQFIRLLLTRKLMGEDRGMLSEAGIRLPKRFEGGLLFGQLVPRFDNRIIAACPVTGEKVPNKHCLEFLEFRWAMTLANIGVGFGTETYRNREGNESTLRPLTGDERRKVDARARRLGFLKAEPDRPGKDGLVRSGRNELREIVVAATNCDRHNLDTLLLHPDAREGLRLLRVKGDTTAFRVAWGSFGDPLDIQGHYHDDPLRHRFTTQLLRLKKLNLRSILSELERLGKVEVALCLRAAAELQAKGKKVKLDPIKLDGLLDAEFSCDKLKGRARYSRAKLAQAVQEVFNKSEPIHPLQKGGCLEQTNEIKQAALDKPMDQQTNNHLVRHRLLILKRLQEHLFNDYADGDKLRVSRITVEVARDVQTTSGMTNKEKAKELGSKIKHHHETAAWLAERLEDERDENGRRFVIGPSLIRKARIADDLGWECPYTGRKFEPADLIHRRYDKDHIVPRSKRLSDALEAMVITSCEVNREKKNRTALQFIKDMNLPENRAVRERLNIRTEAQFREFVDELKAKGSHADDVRRRKRRKELLLVQKYEEKEFTPADLTKTRFINKLAAQQLQAAFRDLPEQQRPP

SEQ ID NO: 329 - protein, 1083 aa, unidentified
  REGION 1..1083: note = Description of Unknown: uncultivated organism with predicted taxonomy: Verrucomicrobia bacterium
  REGION 1..1083: note = MG2-13 effector
MNTTASPDTTSKKSIGDLSLAFDVGHSSIGWAVLQNIDASAPSILGCGAVIFAADDCLASQRRTFRRQRRHVRSTRQRIARMKALLAHLGVLSREQLDQPGCAWPWQLAARALCGGPLLNWSELWDVLRWYAHNRGYDGNRRWSAADIEMLKEDTEKEENAINLMQKNAVTTMAETFCKELGVDPLGSKKSSTVRFKGFNAAFPRKTVEDEARRILRAHFGKLEKVNTDFKRALLGRDTNDKLAWQAISCPDLKLPKRYQGGLLFGQLVPRFDNRIIMRCPITGEKVPTRHCAEFLNFRWGMQLANIRVASGDGRELRPLNVEERKATDAQMREQGSMTEGELKKAVRSVTGCSRDNLDTMLMHPDAKDALLLDPVPKLTKSDKLKPLWPVLPERVQRRAANIWRRGKAITLLGLRERIQMAGGSLATFDGEVERLLDAANTKRRRKVQPITREEFLAEPLVVRRLEGRAAYARLILRRAFEEVMAGKHPKEEGGCLFRSEEVRAAQLQRRIDEQTNNHLVRHRLLILERLQRDIVKEYLGGKSAHIGRVTIEVNRDLREMSGKTAKEKAQDLGQRLANFKNVAEKLEEAFEGKDVHISPGLIRKARIAEDLGWTCPYTHHSYDAFQLLNRTVDKDHIIPRTERASDSLDSLVITFSAINKWKGKRTAMKFVEDEQGNPVPDMPNLSIVTLTHYKAFVEGLDTFRGHDDDKRRKKNRQRLLLVRDYEKPEFTPRDLTQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVPTEMTGLRVEQNAWRVVGIADGEALLRQRIRQPDGSRPVKEKRERTEKLIGPEPHNGTGKLKRNKAALIIPDNYGLALDPEPTIIPFHKVWTRLQDLKGANNSKTPRVLRNGQLIRVAESAGEYKGIWRVFSTKNAAVGFLVDMGRPDVVRLKNGVEGHKINVRLSSLLKHGVELVRSNYAGMAACPSTLSA

SEQ ID NO: 330 - protein, 1077 aa, unidentified
  REGION 1..1077: note = Description of Unknown: uncultivated organism with predicted taxonomy: Verrucomicrobia bacterium
  REGION 1..1077: note = MG2-14 effector
MSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDTRGESHTFSPKEFREFVGGLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 331 - protein, 1079 aa, unidentified
  REGION 1..1079: note = Description of Unknown: uncultivated organism with predicted taxonomy: Verrucomicrobia bacterium
  REGION 1..1079: note = MG2-15 effector
LRMSLALSFDIGHSSIGWAVLDVKGKDPEIVGCGSVVFPAEDCQNQQRASFRRQRRHIAATRNRIKRLEAFFVASGVLSEKDIWECRRRPHPWPWLLAARTIVSGQTLSGVELWAVVRWYAHNRGYDGNALWAGEDSNQDDVMKVQAARQLMDKCGTETMCETICSLLEADPRSDSNPKPKHYFKGENAAFPRQTVTDEARSVLELHIAKIDGVNEAFVSALVDEWRRAKSAGFDVKLPQRYCGGLLFGQLKPRFENRIIPKCRLTGEKTPSKHSREFYRYRWAMFLNNLRVHDLMTGFSRPLDSNERVKLDGIMREAGYFTKTTLTKALVKELQLEPANLEAMLLLPEMENALTLDPALREVSTNKILKTIWPCVDNVWQRVFLNQLFHERRFRGQPVSLNQWRDRLLSDGKSVEDFDKALQSAFETEASFLWNKKNLKVTFEQFLSRPICLTSKHVASGRAPYSKSKLRAAVDAVMQGEDPRMIGGPLEETIEVGQRQRDKEIDQNSNNHLVRHRLKIFARTLNDLVARYASGDASRVNWFAVEVVRDLVQFSGKTAKEKSQILGQQLWHHRKIVSYLEEERENTNGTWDINAGLIKKVRIADDMGWQCPYTGKTYSLNDIIHGEVDREHIIPRSSRPTDALHALTLTFRQINKEKGARTALQYIEDPRGESHTFSPKEFREFVGRLKNKNGPAKDDEVRCKKRKIALLTPIYERRGKVKQTDTGEEVLEAFTDGTLSQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNPRTMRGLRVQQNVWRVEGEDPQDDSKLLISMRPRNEEGSKGFSKQRSEKKSKLLGPSPNIGSGKLKELKGALIVEDNFGLALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 332 - protein, 1137 aa, unidentified
  REGION 1..1137: note = Description of Unknown: uncultivated organism with predicted taxonomy: Verrucomicrobia bacterium
  REGION 1..1137: note = MG2-16 effector
MKTSHSSPDLELAFDVGHGSIGWAVLQNGSQTQIKGCGVVIFRPDDCLASKRREFRRQRRHIRSTRQRIKRMKLLLAHLGVLTQEQLDKPGCAWPWKLAAQVLVGGPTLTWPELWDVLRRYAHNRGYDANRRWSTIEIDLDEEQEDTEKLKTAEGLLKKHGVRTMAEAFCKELGVDPLGSKCASKVWFKGVNAAFPREVVEAEVRSILRAHFGKLKAVDELLEKALCDDWRAIECPAIRLPKRYEGGLLFGQLIPRFNNRIISKCPITGKKVPSRNCPEFLKFRWAMLLANVKVAGTADRELRPLTVAERQAVDAKMREKGALTAEEFKHAVRTASGCSRDNLDAMLMHPDAHEALLLDPVQRELSRDELIAALFAKLPVRIQKRARGQLRRGKTITLGQLRDQAIALGESVEAFDNELNRLLEAATIRRRRKKDAALTAESVLKRSLYVEKLTGRAPYSREILVKAYEEVMAGKHPAEEGGCLFVTDQMREAQLQREIDEQTNNHLVRHRLKILDRLLRDIITEYAGNDKTRIAKITIEVNRDLREMSGKTAKEKAQYFRLLTADHHRVAEKLKKALAGQTVDGKPIRISASRIRKARVAEDLNWTCPYTGQKYEPIDLVTERVDEDHIVPRSQRMSDSLESLVISFSAVNKWKGKRTAMRFIKEEQGKPVPGLPNLSIVSLNRYLEFVDSLPPRNDPRKLKRHLKLLQPIDDDLRKWRRKELLKLEEYEQEEFTPRDLTQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIPKRMTGMRVDQTVWRVFDPQDQHPSARRLARWFKKAGVNVPAPDADTVLIVCRKRRSQPDSETGKTLHETKTWRWVYQEIAKSKLIGLQPRPGSEGRLKKLKAVKILADNYGVALDPEPQIIRFHKVWPQLNELRQKNGSKPVRVLRNGQLIRVPRGTYAGIWRIVSTKSTEAFGLALDLALPDRVKLTRGNVPIKRLIEDGLEVVDCPYTGVDASKIEFAPVKKRPRKSKTAPAETTTPPSSSA

SEQ ID NO: 333 - protein, 1471 aa, unidentified
  REGION 1..1471: note = Description of Unknown: uncultivated organism
  REGION 1..1471: note = MG2-17 effector
MGNRADLELAFDVGHSSIGWAVLKTQPELEMKGCGTVIFRPDDCLASKRRDYRRQRRHIRSTRLRIERMTNLLLGIGAITQSDVESGKKQHKGEPPPWLLAARVLAARTETEKAKALLTWPELWKVLRWYAHNRGYDANVRWSGESKVEAFSPSPQINTEDVEEQAVEAEESELADVEVAEDSDSDSDKLRAGKHLMSSKYGFHTATFAETVAKILLGPKRDVKPGQAGKTGKLAETTESFSESDFRKLLFDTPTESWSHPRHLSIYFKGIRAAFPRRIVKVIGGQRTLVGGTEWEVRAILRAHFDAPKGKALCDETFEAAICGRLPETREDWRAYAETHPTLYLSSDDQAKLRSLRAPPKASQEKSERIRQQRRNILTGKLFLPSRYEGGLLFGQLGTRFFNRIISRCPFSFARIVAAILSGDENTLRLYGTTLAAVNRSRHSRNGVMETDLDLARRWAAKLSKVPAAKSREFLLYRWAMTLANVIVARPGRERLTGYERRCIHRRLRRTGYFTKDSFKEAVRQTTGCEPANLDQMFDTTTEAENSLFIDPVRKYLATNEVAGVVLPVLSQFLQVRLARLLQKGKGVRVREIAEWLDETAKRELSQRIEQYVQENNAKAKAAKKKPHDTHSPDEDRRKKQNKLTAAAVLRVRLEAPLPKGRASYHRVVLRKAVAEVLKGFDPRKPKRDRSNPDGENKPSHGCLFRTPETNRQLLGNPNNEAEYERWKQRWLSHQKNYQRYIARERLSPGSGEAFVRSEYHAAQSYRWLASQSNNHIVRHRLTILDRLLRDIIADQNYCAGDPKRIRRISIEVANDILTFSGLERKQLSGQVMPSLREHHDHVVRLLQQELKGTQWENKIDGELIWKAKIADDLGWWCPYTGKKYSPCELASGEMDVDHIIPKSRRLTNAMSAVVVTFKTINNLKGDLTAWEFVERYQDQPVGPHGEKVRKLWDYERFVKNPDNEMDKPRLSGETGHSDYPRWPKYLPGSRRKLHPDYVRRKLRRRYLLLKHYEKDKDTFTPRDLTITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTPADMSGLAAEETVWRIFDPSDNHPSARRLKQWFEKKIKDGEIQKLPDPTNEADKTVLIVCRKRRDAKSNDKGKTLHDTGNVWRWVYDEVNKVRVVGLNPGKLHRIKAVKLIRENFGIALDPEPTIVPFHKVWQRLMELKAKNGGKMPRVLRNGQLIRVLSGSRAGLWRVTSVKQTEAYGLVLDLAYPDSVHLSRPNAPVEQLLKEGLEILKHSLTGYDASVVAYAPVKRRPRKPKAAQSEQ

SEQ ID NO: 334 - protein, 1003 aa, unidentified
  REGION 1..1003: note = Description of Unknown: uncultivated organism with predicted taxonomy: Verrucomicrobia
  REGION 1..1003: note = MG2-18 effector
MKTLLRHLGALTQEQLDKPGCAWPWKLAAKVLVSNGAHTLSWPELWDVLRWYAHNRGYDANRRWSGAEVDAQEEQEDAEKLKTAKNLLQKHGVQTVAETFCKELGIDPLGQKSASTVRFKGLNAAFPREIVEEEVRRILRAHFGKLKGVDENLERALCGRDSRDKDAWQAIPCPDIHLPERYEGGLLFGQLVPRFDNRIISKCPITGQKVPARNCREFLEFRWAMQLANVKVAATGNGPLRPLTADERRQVDTKMREKGALTPTEFKEGVRVATGCVRDNLETMLMHPDAREALTLDPVQKALTSDERIAALFAKLPARIQKRARGQLRRGKTITLGQLRDHALAVGESVTDFDEELGRQLNAAAAKKRKKDAGISRESLLARPLHVEKLSGRAAYGREILRKACEEVMAGKHPKEEGGCLFVTEQVRQAQIQRDIDQQINNHLVRHRLKILERLFHDIIAEYAGGDKSRIGRITIEVNRDLREFSGKTAKEKAQDLGLRIADHHRVAEKLQKALAGQTLNGQPIRIGPALIRKARIAEDLGWTCPYTGQKYEPIDLVTRRVDKDHIVPRSQRASDSLDSMVITFSAINKWKGKRTALKFVEDEQGKPVPDLPNLSIVSLSRYRDFVEKLDTFKGHDQDKKRKKRRKALLLVRDYEEEEFTPRDLTQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVPKRMTGLRVEQNAWRVVKIEGDEAIIRQRMRQPDGSRPVKETTERVTKLFGLNPVGGSGKLKALKAALIIPENFGIALDPEPTIIPFHKVWPRLQELKKANGGKWPRVLRNGHLIHVPKGRYQGTWRVFSAKNNKSGMAVDMGWPDVVRLRNGVQGHKINVLLASLLRDGMTILDTPLTGVASPVR

SEQ ID NO: 335 - protein, 1125 aa, unidentified
  REGION 1..1125: note = Description of Unknown: uncultivated organism with predicted taxonomy: Verrucomicrobia
  REGION 1..1125: note = MG2-19 effector
MQEKILSTKDGGKNLEVSFDVGHSSIGWAVLKSPDKNGENNPEFPQIELLGCGVVTFEPDTCLAKKRRDYRRQRRHIRSTKMRIKRMKQLLEHLKVLTPSELEKPGSPYPWKLAASVLQGKHLLNWNEIWDVLRWYAHNRGYDENRHWSEVAEKDKDDTESVKKSIELMKEHQTKTMAETICKELGTDPSESDKRASHKSYKEVGAAFPRSVVVNEVREILDKHIGKLPGLSQELVETLVGESKDAWKTIPCPSINLPSHYWGSLLFGQLLPRFNNRNIKKCPFSGDTLPLKECVEFYRYRWGKILTNIRVSANGLFGQKRPLNPEERKYVDSKMRELGSMTETELQKAVEEAVLMTLNKEGILKPGKINTNLETMFLTPEMEKGLVLDPVKNLINSDTVQSFWGVLPPQLQKRLTGKWRRGKQIKIGEIQKELEKIAPEKVEEFISTIKKNLKGKNKNQNYLEIKIPDSPLKQLKGRAPYGRKLLQQAYEEVLEGKDPHEKGGCLYRAENILKEEIQEDIEKQTNNHLVRHRLLILERLFDDIVKEYAGNDKNKIKLITIEVNRDLREFSGMTAKEIESELNARSADFKKAKKQLEDMLLKAGLSNTRITATLIKKARIAQDLDFTCPYTGAKYELIDLINKQVDLEHIIPKSKRPSDSMESLVITFKEVNRWKGNRTALRFIKEEQNKPVQGKGNLMILTEKRYQELVNGLNTKGHPKDTERKKKRKELLLMEDYVEEEFLPRDLTQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEGKKYVWQYDIVRKTKLLGIEPIGGNGKLKRLKAAKLIGENYGIALDPKPQIIRHFKVYQTIRELKKLNNGKPPRILRKGSIINVPKGRYKGVWKITSIKDSKDEIKVNILRPQAVKNVGKTNYSKGDVLLRTLIKNGMQVIEAPYTGVNVALYS

SEQ ID NO: 336 - protein, 834 aa, unidentified
  REGION 1..834: note = Description of Unknown: uncultivated organism with predicted taxonomy: Verrucomicrobia bacterium
  REGION 1..834: note = MG2-20 effector
AARQHLTELAARQGAFTKGEFKKAVREAAGWPEKGGHDNLDALLLHPDAEEALVFDPVQAALRKHPLAEAFLTLPPQFLKRLRGKLARGKSVAPGTVRDWLSRAQAPPPSASDPLAAFDAAIQRVLDAANTRKGRKQSALTREQLLEEPLRATYPKGRAPYARPVLRQAYEEVMKGWDPRAEANDHQPRGCLCQTDELKEAQLQRRLEEQTNNHLIRHRLLILGGEQPKPNATPEHERRRLKGLLHDLIQDFANGDKSRIASLTIEVNRELRDLSGKTRKEQEQDLGLRLGDFKRVAAKVEEACRRRGIPCTAGLIRKARVAEDLGWKCPYTGKEFSVDTLLDGVMDKDHIIPHADRQSDSLDSLVITWNEVNKWKGKRTALEFIREEGGKPVPGRPELTVMTLAEFQKHVASLDIRKGHDDDRARKKRRIRRLLTEYYEEKEFTPRDLTVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIPADMSGVKVEENTRGVVAVKDGRVILRQRSARDAKTGLQAVKTTDEAPGKLLGLNPPGGDGKLKRQKGVRVITDNFGVAILDHAPEGEEKFVVIPWHRVWHRVEELKAANGGQRPRLLRNGMLIRVAGLPGKMASKNGVWRVFSVKQTKKLDLGGPDRVAMEDKGLGVWREVSLETLTPARIAILRHGLAGGPQPDP

SEQ ID NO: 337 - protein, 1129 aa, unidentified
  REGION 1..1129: note = Description of Unknown: uncultivated organism
  REGION 1..1129: note = MG2-21 effector
MQEEILNTSDVSKNLEVSFDVGHSSIGWAVLKSPDKNKMNNPEFPQIELLGCGVVTFEPDTCLAKKRRDYRRQRRHIRSTKMRIKRMKQLLEHLKVLTASELEKPGSPYPWKLAASVLQGKRLLNWNEIWDILRWYAHNRGYDENRHWSEVAEKEDEDDTESVKKSIELMKNHQTKTMAETICKELETDPSESDKRALHKSYKEIGAAFPRSVVVNEVREILEKHIGKLPGLSQELVETLAGESKDAWKTIDCPPIKLPSHYWGSLLFGQLLPRFNNRNIKECPFSGDTLPLKECVEFYRYRWGKILTNIRVSADGLFGQKRPLNPDERKYVDSKMQELGSMTKTELRKAVEEAVLMTLNKEGVPQPVKINTNLETMFLTSEMEGGLVLDPVKKLINSDTVQSFWGVLPPQLQKRLAGKWRRGKQITIGEIQKELEKIAPEKVEEFNLAIKSNIKRKKKTENHLNDKIPESPLKMLKGRAPYGRKLLQQAYEEVLAGKDPHEKDGCLYRTENILKKEIRKAIDKQTNNHLIRHRLLILERLFDDIVKEYAGNDKNKIKLITIEVNRDLREFSGMTAKEIESELNARSADFKKAKKQLENMLQEAGLSNTRITATLIKKARIAQDLDFTCPYTGAKYELIDLINKQVDLEHIIPKSKRPSDSMESLVITFKEVNRWKGNRTALRFIKEEQNKPVPGKENLMILTEKRYQELVNGLNTKGHPKDTERKKKRKELLLMEDYVEEKFLPRDLTQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIPKDMSGVKCDETIYRVVDPNDNHPYAKKLIRWAKEKDIQIPSADDDTALIVAKKRRGADGATGSKILHEHKGKTKYVWQYDIVKKTKLLGIEPVGGNGKLKRLKAAKLISENYGIALDPKPQIIRHFKVYKTIQELKKLNNGKPPRILRKGSIINVPKGTYKGVWKVISIKEGYSEIKVDILKPQAIKIVDKTDYCKREVLLRTLITSGMQVIEAPYTGVNVALYN

SEQ ID NO: 338 - protein, 1471 aa, unidentified; identical to SEQ ID NO: 333
  REGION 1..1471: note = Description of Unknown: uncultivated organism
  REGION 1..1471: note = MG2-22 effector

SEQ ID NO: 339 - protein, 778 aa, unidentified
  REGION 1..778: note = Description of Unknown: uncultivated organism with predicted taxonomy: Verrucomicrobia bacterium
  REGION 1..778: note = MG2-23 effector
MQLANVRVAGSGNGQMRPLTADERRRVDAKMREKGALTPTEFKDAVRSATGCVRDNLETMLMHPDAKEALTLDPVQKLLTSNECIAALFAKLPARIQKRARGQLRHGKTVTLGQLRGYALAVGESVADFDEELQQQVDAAATKGRKKVAGVSRESLLAQLLRMEKISGRAAYSREILRKACEEVMAGKHPKEEGGCLFVTEQMRQAQIQREIDQQTNNHLVRHRLKILERLFRDIIAEYAGGDKSRIERITIEVNRDLREFSGKTAKEKTQDLGLRVADHHRVAEKLQKALAGQTVNGQPIRIGPGLIRKARIAEDLGWTCPYTGQKYEPIDLVTRRVDKDHIVPRSQRMSDSLDSLVITFSAINKWKGNRTALKFVEDEQGKPVPDLPNLSIVSLSRYREFVEKLETFKGHDDDKKRKKRRKALLLLRDYEEEEFTPRDLTQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIPKRMSGLRVEQNAWRVLKIEGDEATIRQRVRQPDGSRPLKETTERITKLFGLNPTGGSGKLKALKAALVIPDNFGIALDPEPTIIPFHKVWPRLQALKKANGGKWPRVLRSGQLIHVPKGRYQGTWRVFSTKNNKSGMAVDMGWADVVRLRNGVEGHKINVLLASLLRDGMTILDTPLTGVASPPL

SEQ ID NO: 340 - protein, 1074 aa, unidentified
  REGION 1..1074: note = Description of Unknown: uncultivated organism with predicted taxonomy: Verrucomicrobia bacterium
  REGION 1..1074: note = MG2-24 effector
MTAKQNLADLHLAFDVGHSSIGWAVLRHTPPPALPEILGTGVVIFGADDCLASKRRQYRQQRRHARATRKRIELLARFLFHRLQGETDPATTQFREHLKPYLEQTAATRQLQGDGDSFAWQRAAEILTAARENKPLPDLGWSELWDILRWYAHNRGYFAPPWANRGDESAAPDTDDEVSDTEKVEHANDLMRELGTRTMAETVAAYTARYEREAAEWQQGRRKEKPKHFKGLNAAFLREKIVWPEVCALLTALKGRLPGLDDAFIRTLLGNDVDPLRDRDAWRTIPCPDIQLPKRYHGGLLFGQVIPRFENRIIGVCPIWFSVCQDLCLHHPEITQDDPLRREKEAVVQAFEQWLPRAKKANERLSPEKQKSPEALIAEFAAKQSKLPAKASPEFLRFRWAMQLANVFGAAPGERETRPLTADERKQLTARAEKQGAFTKGEFKQAVREIAGWLEQSSRDNLDALLLHPDAEQALIFEPVQAALRKHSLAEALLALPPQFLKRLRNKLTRGKEVKPQAVRDWLGGAQASTPSASAPLAAFDAEVQRVLEAAATRRAKKQTALTRDTLLAQKLCATYPKGRAPYARPVLRQAYEEVMQGWDPRAEKRADQPRGCLCQTDELKEAQLQRRLEEQTNNHLIRHRLLILERLQRDLIAAPEFANGDKSRIAGMTIEVASDLRDLSGKTRKEQEQDLGLRLGDFKRVAAKVEEACKRRNLRVTAGIIRKARVAEDLGWRCPYTGKEFCIDTLLDGVMDKEHIIPHADRQSDSLDSLVITWNEVNKWKGKRTAMEFIREEGGKPVPGRPELEIMSLAAFQKHVASLDTRKGHDDDRARKKRRIRRLLTEHYEEKEFTPRDLTVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVPADMSGVKTEENTRRVLRVREDGRVELRQQAPRDA

SEQ ID NO: 341 - protein, 1337 aa, unidentified
  REGION 1..1337: note = Description of Unknown: uncultivated organism
  REGION 1..1337: note = MG2-25 effector
MGTPTLSSDPNAKLELAFDVGHSSIGWAVLRPVAADVRRLTSTPAKESSQSLVTSAATGIELLGCGVVTFGADDCLASKRRDYRRQRRHARSTRQRIARMEKLLAALNVIPKAELERLHSQAKGHSKQNPHERKGASAPWLLAARVLAARTEEERKKAELDWPELWDVLRWYAHNRGYDGNIRWSGGFRVEAFSETPQVSVSALTEQVDKAKQNEDDPDEDWKKLESAAKRMADYGFTSPTFAEMVAKYLLGPDRTLKPAQPGKPAEVEPTKASFTEADLHKLLFHCEPGFEHHPRHLSNYFKGLRAAFPRRIIKDIDGKPTLVGGTEWEVRYILRAHFGTLTGCDARFEQVVCGGIPEAETDWLALGELLPALYLSDDQKRQLKALRIPKDAFAGDKPGRKREKERLRFLRTAITRDKLVVENRYSGGLLFGQLVPRFDNRIITRCPISGDKVPVKQSPEFLRYRWAMQLANIQVAASAQEKLRKLTADDRAALHKLMQAKGALTEGELKKAVRALPGVARDNLDTMLMHPDAKDALIFDPVQKLLASDELAPFWATLPANLQARFRGKLRHAKAITLADLRTALPDPKAFDVELQRQLDAQNTRKAKKQPAFSRDQFLAQSFDARKALARLSGRAPYARPLLQQAYEQVLAGKDPREEGGCLFRSEEIRQRELHKKLEDQTNNHLVRHRLLILERLLKDLVNAPEFAAGQPERVAQVTIEVNRDLREFSGMTRKAIEMDLGSRLKNFKSVSDKLEKAFDSQTYNGKPVQVTAGLIRKARIAEDLGWQCPYTGQSFEPVHLVSRAVDKDHVIPRSQRPSDSLESLVVTFSEVNKMKGQRTAWQFIQEFGGKPVEGMPNLMIRTPKQFEEFVTKLESFKGHEDDKRRKKRRKDLLLLPKFEDKGFVPRDLTLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIPADMSGMKVEENTRGVVKVENGRATLRQQKRNAEGKLEVKETEEVVGKLVGLHPEPKREAHPSPALRAPSPLAGRGEREESNDAAAGSPPSPFAQRGERDGVRGAAQGKLTPMRGVRVITDNFGVAILDHASNPDDRFVIIPWHKVWHRIEALKEKNGGQPARVLRIGTLIRVPNKSGRSDYRGTWMIRGAQLNQNAGMLVDLSNPDVITYRVSGRKDCKQNVSLKSLVEGGLEILKPSLCGVAQTAQAMAPG

SEQ ID NO: 342 - protein, 853 aa, unidentified
  REGION 1..853: note = Description of Unknown: uncultivated organism with predicted taxonomy: Verrucomicrobia bacterium
  REGION 1..853: note = MG2-26 effector
QRLAKGASAAEATAHARKLAKVPSRNCPEFHRFRWAMQLANVQVASGRSPELRPLTVPERRQVHARMLQRGFLTAAEFKKAVREITGATRDNLDQMLMHPDAQEALILDPVRRLVTTSPILEAVWPQLPEAAQKRAAGQWRRGKTLTLQDVVRHTNAAERARIEAAVKNHLDLENTRRKKKDKTLRADEIMTQPLSIKRLSQRAPYTRVVMDEVWADVMERGLHPKEKGGCLYRDEAIRQAQLQREIDEQTNNHLVRHRLRILERLHRDILQEYAQADPARVARVTIEVNRDLRELSGKTRKEQEQDLGQRLANFKSVVRKLEESFDGKKVKITPGLIRKARVAEDLGWTCPYTGKAYDAFDLLNRAVDKDHIIPRSQRASDSLDSLVITFAEVNKMKGKRTALRFIEEFQGQPVPGAPRLSLRTLRDYQQWVEGLETFKGHPDDQRRKKQRKKLLLLPEYVEKDFVPRDLTQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIPSDMTGLAADQTVWRVFDPADSHPSARRLARWFKEAGVKVPPAGADTVLITCRKRRSQAGAETGRLLHQSPTWRWIYQEIPRSKVIGLEPRPGSPARLQRLKAVKILGDNYGLALDPEPQVIRFHKVWSQLQELKRRNEGKPVRVLRNGQLFRVQNGRYRGIWRVFSTKDNSSGMALDMGYADVVRLRNKTEGHKINVLLSTLLRDGLCILQSSYIGVSTCPTTSSA

SEQ ID NO: 343 - protein, 1016 aa, unidentified
  REGION 1..1016: note = Description of Unknown: uncultivated organism
  REGION 1..1016: note = MG2-27 effector
MASLEFSLDVGHSSIGWAVFQSDPFQPLGAGSVIFGADDCLAKKRRDYRRQRRHIRSTRQRIERMKQLLSHVGFLTREQLDQPGTAWPWLKAAEVLKPEGGVKLSAQELWDVLRWYAHNRGYDGNRAWARDETEAQEDTAREQAARQWMQDHNTQTMAETVCAVLDVGPGKRSDGGDKRSSNLRFKGRGVAFPRSVVTSEVRHILENHQGKLPGLDSRTIRILMDDARHENLAAEAGIRLPHRYEGGLLFGQLIPRFDNRIISSCPVTYEREYARALDEGKSEDEAKHQAVRQAKVPAKKSREFLLFRWAMILANVQVADASGTRPLSVEERQSLHQLMVKSGKLTKREFLKTLDATVGSPRHNGSALLMPPDADKALVLRPEKDALKRLSGRAPHARVVMKQAVKDVFAGRHPMAEGGALFRSEELRALQLRRTVEEKTNNHLLRHRLLILRRLVKDMLATYAGNDPSRISQVTIEVNPDLRSFSGMTAEEKKQEMGQRLGDFKKVVQKLRGDLPEVTAISAGLIRKARIAQDMNWTCPYTGMEYDALDLLHGHVDKDHIIPRSLRPSDSLDSLVLTLRTINEMKGQRTAVQFIKEFEGREVQDGKKRSLEILPWSQFQKLVESLDAKGIHDQDRARKKRRKALLLQEHYTEKEFVPKDLTQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIPSNRRGLKAEETVWRVLDSEDHHPSAEKLRKWAQLAQVELPNPDSGKVLLVKRIRHTAAGAKAPKNLLHQGSEFWWAYEVVALSKLVGPGASGKLRKIKGAKQIGDNFAVTLGPKMEVIPHHQVQERWKGLGCPRYLRNGQIIEMPTGKYSGAWKVFSIKNARQGILLDIARADSPRAKQGNPGTRINVLLKTLV

SEQ ID NO: 344 - protein, 1081 aa, unidentified
  REGION 1..1081: note = Description of Unknown: uncultivated organism with predicted taxonomy: Verrucomicrobia
  REGION 1..1081: note = MG2-28 effector
MTTQRNSSPNASRKFGGQLAFAFDVGHSSIGWSVLTAPERDHPEILGCGVVLFEKDSALACQRRQHRRQRRHIRATRQRIARMEKLFMHIGALTREVIESKHRAGGGNSAPWLLAARVLASNGQKTLSWQELWDVLRWYAHNRGYEPVSDEAEADKEDIEKVENAKREMGRLGTVTMAETITAWLGLDTFGKRAASRENYKARNCAFDRGMVVAEVRRILEAHVDRLPGLDERVVKAILDDVHAIEVPSIRWPRRYRGGFLFGRLATRYHNRIIGKCPISGAKLPKKRCREFLCYRWAMLLANIRVVDSDDGRSRPLSREERSNIHKSMERKGYLTPGDLKRLVGTLPGVKQHNVDQIVVHPDAGEALVFDPIRKLIVSNERVAAVWETLPPQVKKRATGKWRRGKSLNLAALRAEVVELGHDVSGFDSAVTTFVSSRQKTRRRSRTHSKETVDDIIEAPIDARRDLAKLSGRAPYARQLLDQAFKEVMDGKDPRARGGCLEETEEVRRRREERPIAEQTNNHLVRHRLQILGRLLNHLIEDPAYGANRPERIRRITIEVNRDLREMAGRTSQEIAKELGARVANHKKVANRLFGELPEGTRITGSLIRKARIADDLGWRCPYTGVEFEPVDLVEGRVDRDHIIPRSQRMSDSLDSLVITFSAVNKWKGQRTAWQFIQEEGGKPVPDAPNLSIVTPARFRDFVEHLDTKGHRDDYRRKKRRKELLLLERYEERTSGFTPGQLTQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVPADMNGMRVEENTRGIVRREDGRVYLRQKTLTSDGRRNVKNSDELDIMVVGLNAGGKLAELKGIRVVKENFGVAILENTSLPSGDRFVIIPHVRVWKQLQELRMRNGGKPPEVWRKGQIVRIPSGNREGKWRIFSVMASNRGIMLKLDRPDSPSFDDSGGASGFKMTLTSLIKRGTIRLETRLTGS

SEQ ID NO: 345 - protein, 1026 aa, unidentified
  REGION 1..1026: note = Description of Unknown: uncultivated organism with predicted taxonomy: Verrucomicrobia bacterium
  REGION 1..1026: note = MG2-29 effector
TVTFESDGCLASKRRVHRGMRRNIRSRRLRIADIEKLFVHQGILSADQIAEKHKPGAGSSSPWLLSAAVLASGGTFVLNAEELFDVVRWYAHNRGYDGNRRWAHNAEDDDGDSDREKAAFSLMDAHHTSTMAETICAQLGLMPGGQKKASMAPYKDSDIGAAFPRKTVVAEVVRVLEAHVGKIEGCSAEFIEALCGENDGAWKTIAVPNLGKPKTFKGGLLFGQKVPRFDNRILPFCPVTNKPTPLKSCIEFMEFRGAMFLSNVRVGSGDGFELRPLSADELNVVWDKIHKKGYLTSRQFKDEIRGLEGVEKDNLQALMTIDSADKNLVVDPALKLISSSTVLKPVMSLLSEASREELLSNLRRKHGVTISEMISDLSISEELTKAIDTSFKKESKKKREKYGTQERWLSERVFSAEFDSGRAPYGRLVMKQAVEEILSGKDPRAKGGCLYLTDEMQKRQESRSLESLTNNHLVRHRLLILKRLFNDMVKEFCEDDKGRILSVVVEVNREVSSMSGKTMKLIKMEEGLKRSDHKKASKIMEAAVEESGENIRVGAGLIRKARVAQDLDWTCPYTGEKFDPLALIHSQVDLDHIIPRSERLSDAMAGLVVTFSEINRWKGARTAYQFISEEQGKQVPGKPNLSIMSLKAYEDFVGKLKISGGHDSDVGRRKARKGYLLLASYQDKEFTPRDLTISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVPSSMEGLKVEENTRGIVAFNEERKKVTLRQTGNETEEVSGKLLGYKTEGSKLADQKGVRVINQNFGVALTHPPQIITWHKVYPKLKKIEQETGRWPQVLRNGMLIHVPEGNYAKASKIWKIFSLKNNASGMAVDMGYADSVKPVKINVLLKSLIKDGLQIIGSDFSGEGICHITSSTLEAQPSD

SEQ ID NO: 346 - protein, 1065 aa, unidentified
  REGION 1..1065: note = Description of Unknown: uncultivated organism with predicted taxonomy: Verrucomicrobia bacterium
  REGION 1..1065: note = MG2-30 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVFKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKNITTEVAGKLLGYDAEDGSKLKKQKGVRVINKNFGVALTQSTPEIITWHKVYPKLSSIYKRDGVWPNVLRNGMIVYIPDGNYAKVSKVWRILSIKNEKRYMAVDIGFPDSCKSVKRSVNLTTLLKDGMKIVYTKLTGDGICHITSSKSIAPPFD

SEQ ID NO: 347 - protein, 1062 aa, unidentified
  REGION 1..1062: note = Description of Unknown: uncultivated organism with predicted taxonomy: Verrucomicrobia bacterium
  REGION 1..1062: note = MG2-31 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNAYPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVPSNMGGMHVEENTRGIVGFDSEKGKVLLQQKKDGLKKITTEVAGKLLGYDAEDGSKLKKQKGVRVINKNFGVALTQSTPEIITWHKVYPKLSSIYKRDGVWPNVLRNGMLISVFSGRYAGIWRILSIKNNATGINFSIAKPDAIAPFKQNVLLKSLMSAGLKKVETKLTGDGICHITSSKSIAPLFD

SEQ ID NO: 348 - protein, 1062 aa, unidentified; identical to SEQ ID NO: 347
  REGION 1..1062: note = Description of Unknown: uncultivated organism with predicted taxonomy: Verrucomicrobia bacterium
  REGION 1..1062: note = MG2-32 effector

SEQ ID NO: 349 - protein, 789 aa, unidentified
  REGION 1..789: note = Description of Unknown: uncultivated organism with predicted taxonomy: Verrucomicrobia bacterium
  REGION 1..789: note = MG2-33 effector
MKKRDLIFSFDEGHSSIGWNVIQETEAGPNVLALGTVTFTADGCLASKRRIFRGQRRTVRSRRQRIEDIEKLFIHQGILSETQAKEKHEQAGGNACPWLLASAVLASNGKFTLNEKELFDVIRWYAHNRGYDGNKRWAGSADDENKEDSAKEEVAIDLMKNLSTQTMAETICAQLGLQPNGHKKASMKKYKDAGAAFPRKIVEKEVLKILQAHVGKIAGCTETFIETLCGENDSAWKKIPVENIKKTKTFRGGLLFGQKIPRFDNRILSFCPITDKPVPLKSAKEFMEFRCAMFLANIRVKDVIASEMRSLSKNELHIIWELIKEKGYLTASEFKRAVRSLGKFSQDNLDGLMIITESATNLIIDPVQKLIHSNQILSVLWSEIPDFIAKECLFQLGKKRSITLSEIISKMEENLSEGFVTALDKAYKKVQKKNPDKQQWLERKNYRASFDKGRAPYGRDIMKKVVLEVLGGKDPREKGGCLYITEEIREKVNHRKLDELTNNHLVRHRLLILNRLFDDMVDDFADGDKERIKTVVLEVNREISELSGKTTKEIKKEEGLKRAEHKKAREKMEAAVKDSGENIVITAGLIRKARIAQDLNWTCPFTGKEYDPIDLIHKQVDLDHIIPRAERLSDSMGGLVVTFSEVNRMKGKRTAWQFIQDEQGKPVKGKPVLSIRTMKNYETFVSKLKTFGGVKSDEARRKMRKQFLLMPDYKEKGFTPRDLTLTSYVTKLALQQIKNQFDTCRKKPQVIALPGRLTGETRKTWKLMGLLHVVNEKIDGKTLKNDIRS

SEQ ID NO: 350 - protein, 789 aa, unidentified; identical to SEQ ID NO: 349
  REGION 1..789: note = Description of Unknown: uncultivated organism with predicted taxonomy: Verrucomicrobia bacterium
  REGION 1..789: note = MG2-34 effector

SEQ ID NO: 351 - protein, 783 aa, unidentified
  REGION 1..783: note = Description of Unknown: uncultivated organism with predicted taxonomy: Thermogutta terrifontis
  REGION 1..783: note = MG2-35 effector
VVIGGSRPLLKEERFALNSIMEATGYFTKATLKKAFEKSLKLDPVNLDAMFLIPEMEQALTLDPARREVTTNKIIKPVWKTVPAIWKNIFSNQLFHGRNYQGKPPSFSQWRDRIKEKGDSIEEFDDSVASAYKVECQNLSKKGLEVSFEEFCGRPIRVSKRHMASGRAPYSRGKLTEAVHCVFNGDDPKAEGGPLEETEAVRCAQWNLEIDENTNNHLVRHRLKVFVRVLEDLVKRYADNDPRNVSSVCVEVVRDLVEFSGKSAKEKARILGQQLWHHRKISKFLEEEKAKNEGNWEISAGLIKKARIADDLNWICPYTGKQYSLNQIIHGDVDLEHIIPRSKRPTDALHALVLTFSHINREKGARTGLQYIEDTKDSPHTLTPEQYRKFVGRLKKNGPSKDDELRCTKRKIALLTQDYEPRGKAKEKSDSESVSGFTEGSLTQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMPGTMRGLKVQQNVWRILGEDSRDESKMVIRMRPRGEDGKKTIKQKTEKKSKLLGALPKNASSKLKDLKGALIVEENYGVALDPEPVVMPYRQVWKQLVELRKQNGGQPVRVIRNGNVISVKKGRYAGKWRVHSIKDASMGLVLDMAAPDLVKAENQSHRSKMNVLLKTLLKNGLVVMQSDSALFSL

SEQ ID NO: 352 - protein, 1114 aa, unidentified
  REGION 1..1114: note = Description of Unknown: uncultivated organism with predicted taxonomy: Coraliomargarita sp. CAG:312
  REGION 1..1114: note = MG2-36 effector
LASYSTKKNGAIIRAAEQENSFTFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSGGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 353 - protein, 817 aa, unidentified
  REGION 1..817: note = Description of Unknown: uncultivated organism with predicted taxonomy: Coraliomargarita sp. CAG:312
  REGION 1..817: note = MG2-37 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVSVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 354 - protein, 1061 aa, unidentified
  REGION 1..1061: note = Description of Unknown: uncultivated organism with predicted taxonomy: Coraliomargarita sp. CAG:312
  REGION 1..1061: note = MG2-38 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDVKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 355 - protein, 1108 aa, unidentified
  REGION 1..1108: note = Description of Unknown: uncultivated organism with predicted taxonomy: Verrucomicrobia bacterium
  REGION 1..1108: note = MG2-39 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPRRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 356 - protein, 1114 aa, unidentified
  REGION 1..1114: note = Description of Unknown: uncultivated organism with predicted taxonomy: Coraliomargarita sp. CAG:312
  REGION 1..1114: note = MG2-40 effector
LASYSTKKNGAIIRAAEQENSFTFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 357 - protein, 1108 aa, unidentified
  REGION 1..1108: note = Description of Unknown: uncultivated organism with predicted taxonomy: Coraliomargarita sp. CAG:312
  REGION 1..1108: note = MG2-41 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 358 - protein, 1108 aa, unidentified
  REGION 1..1108: note = Description of Unknown: uncultivated organism with predicted taxonomy: Coraliomargarita sp. CAG:312
  REGION 1..1108: note = MG2-42 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVVPEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 359 - protein, 1108 aa, unidentified; identical to SEQ ID NO: 357
  REGION 1..1108: note = Description of Unknown: uncultivated organism with predicted taxonomy: Verrucomicrobia
  REGION 1..1108: note = MG2-43 effector

SEQ ID NO: 360 - protein, 1114 aa, unidentified
  REGION 1..1114: note = Description of Unknown: uncultivated organism with predicted taxonomy: Coraliomargarita sp. CAG:312
  REGION 1..1114: note = MG2-44 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMDDLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 361 - protein, 1101 aa, unidentified
  REGION 1..1101: note = Description of Unknown: uncultivated organism with predicted taxonomy: Coraliomargarita sp. CAG:312
  REGION 1..1101: note = MG2-45 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWGLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKS

SEQ ID NO: 362 - protein, 1114 aa, unidentified; identical to SEQ ID NO: 356
  REGION 1..1114: note = Description of Unknown: uncultivated organism with predicted taxonomy: Coraliomargarita sp. CAG:312
  REGION 1..1114: note = MG2-46 effector

SEQ ID NO: 363 - protein, 1108 aa, unidentified; identical to SEQ ID NO: 357
  REGION 1..1108: note = Description of Unknown: uncultivated organism with predicted taxonomy: Verrucomicrobia bacterium
  REGION 1..1108: note = MG2-47 effector

SEQ ID NO: 364 - protein, 1114 aa, unidentified
  REGION 1..1114: note = Description of Unknown: uncultivated organism with predicted taxonomy: Coraliomargarita sp. CAG:312
  REGION 1..1114: note = MG2-48 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPEISPNGSILRKARIADDLGWVCPYTGCHFSPRQLFESGNMEREHIIPRSLRPSDSLESLVITWKEVNDMKGQCTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 365 - protein, 1108 aa, unidentified; identical to SEQ ID NO: 357
  REGION 1..1108: note = Description of Unknown: uncultivated organism with predicted taxonomy: Coraliomargarita sp. CAG:312
  REGION 1..1108: note = MG2-49 effector

SEQ ID NO: 366 - protein, 1114 aa, unidentified
  REGION 1..1114: note = Description of Unknown: uncultivated organism with predicted taxonomy: Coraliomargarita sp. CAG:312
  REGION 1..1114: note = MG2-50 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKIGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVCEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 367 - protein, 888 aa, unidentified
  REGION 1..888: note = Description of Unknown: uncultivated organism with predicted taxonomy: Coraliomargarita sp. CAG:312
  REGION 1..888: note = MG2-51 effector
VDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTAYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIAREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 368 - protein, 1108 aa, unidentified
  REGION 1..1108: note = Description of Unknown: uncultivated organism with predicted taxonomy: Verrucomicrobia bacterium
  REGION 1..1108: note = MG2-52 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLVVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 369 - protein, 1108 aa, unidentified
  REGION 1..1108: note = Description of Unknown: uncultivated organism with predicted taxonomy: Verrucomicrobia bacterium
  REGION 1..1108: note = MG2-53 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTLKTIFKSLLGELPLNYESMFLSEEMDKALLLDPVRALILKTIYPNISHSLPSAELVQNLWDLIPKFIFTQMFRLKEYSLEDIYGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 370 - protein, 865 aa, unidentified
  REGION 1..865: note = Description of Unknown: uncultivated organism with predicted taxonomy: Coraliomargarita sp. CAG:312
  REGION 1..865: note = MG2-54 effector
MSINILNNLRESNKFELSFDIGYSSIGWSVFKKQSGGIFPTLLGAGTVIFDDDACLAKSRAGFRRMRKNIASRRNRIKRLRDAMLNLDVMAVDELDNAKTAYPWFLSAKVLACGKKLSWSELWSVIRYYAHNRGYDGNSAWAEIESDSDGDFEKEANAKKLMAELGTSTQAETVCAYLGVDVKSDKPLSLRKYFKGQNLAFPRETVVKEVERIIDAHIGVLPKCDGNFKKLMIGNWREVPSNIELPRRFTSDRGLLFGQYIPRFDNRIITKCPISGEKTPNCHSREFLDFRWKSLLANMAFPDGADLIAARAKVDAAMFLYGALKKTVLKKILKEVLGELPSNYNAMFLASEMEKALELDPVKALILKTAYPNISFSLPSAELVEKLWKLIPKFVFTRMFKLKEYSFADICALLDSEKSEELKNVVRAIFDSSASSKKSPKPDFETAFNYKMRVKKISGRSPYSRRLMKLASEEIMRGIDPRSEGGSLYPRRDSTRKELLSNIDSWTNNHLVRHRLKMFKRLYMDIVNEYCGGDISLVKSVAIEVVKDMTAFSGLDSKKKAAKLKDLVAHHESVSKYLKNEYPNLKTNGSILRKARIADDLGWVCPYTGCHFSPRQLFESGNMEKEHIIPRSLRPSDSLESLVVTWKEVNDMKGQRTALEFIKECQGMKVPGRPNLSIVTPARFEEFVSGLRKPMHRAGKADIERIKIRNKLLLTEHYKNREGEFLPSDLTQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 371 - protein, 1061 aa, unidentified
  REGION 1..1061: note = Description of Unknown: uncultivated organism with predicted taxonomy: Coraliomargarita sp. CAG:312
  REGION 1..1061: note = MG2-55 effector
MSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVDRIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 372 - protein, 1114 aa, unidentified
  REGION 1..1114: note = Description of Unknown: uncultivated organism with predicted taxonomy: Coraliomargarita sp. CAG:312
  REGION 1..1114: note = MG2-56 effector
LASYSTKKNGAIIRAAEQENSFIFEVPYERAVFKFEPLILSLIPFKINDNNLKMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPRRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 373 - protein, 1108 aa, unidentified
  REGION 1..1108: note = Description of Unknown: uncultivated organism with predicted taxonomy: Coraliomargarita sp. CAG:312
  REGION 1..1108: note = MG2-57 effector
MSRSDFCLFKLSFDIGYSSIGWSVFKIAHGDAFPILCGCGSLVFDDDCCMAKSRAAFRRARKNIASRRNRIKRMRKVLLSMGVMGPEELDNAKTDYPWLLASRVLSCGNKLSWGELWSVLRYYAHNRGYDGNSAWAKFDGDDGDSEKEANAIKLMQELGTRSQAETVCAYLGVDPSSSAKPALRKYFKGQNVAFPRQIVISEVGRIIDAHIGHLPGCDENFKKLIMGNWREVPSPIEMPGRFTSDRGLLFGQYVPRFNNRIIPKCPIEGRNVPSCHSREFLNFRWKSLLSNMSFSEGIDIAAARKNIDSAMRLYGSFKKTTSKTIFKSLLGELPLNYESMFLSEEMDKALLLDPVRALILKTIYPNISHSLPSAELVQNLWDLIPKFIFTQMFRLKEYSLEDICGLLEDKKRARFRSLLLEIFDSSPNSKKTPRGDFENVFKLKMRINKISGRAPYSRIAMKKACAEIMEGRDPRANGGALYRNAENARSELLSNIDTWSNNHLVRHRLKMFKRLYVEIVNRYCGGDLSAVKSVAVEVVKDMGEFSGLDPKERAAKLNDLVCHHKSVSEYLEETYPELKISGSIIRKARIADDLGWVCPYTGRHFSPRELFESGNMELDHIIPYSLRPSNSLESLVATWKAVNEMKGQRCAAEFIKECQGMEVPGMPNVSIVTPERFEKFVSGLKKPQHNARYPDLKRIKKRNKLLLTLKYNKREGEFLPADLTQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLPRKMSGMDVEQTLWGVVKEDVGGLVTIRQYHSKANSAKRRERKIEIEKKIKLLGYEPENVAESKLARNKAVIIIKGNFGVALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 374 - protein, 1108 aa, unidentified; identical to SEQ ID NO: 357
  REGION 1..1108: note = Description of Unknown: uncultivated organism with predicted taxonomy: Verrucomicrobia bacterium
  REGION 1..1108: note = MG2-58 effector

SEQ ID NO: 375 - protein, 1061 aa, unidentified; identical to SEQ ID NO: 354
  REGION 1..1061: note = Description of Unknown: uncultivated organism with predicted taxonomy: Coraliomargarita sp. CAG:312
  REGION 1..1061: note = MG2-59 effector

SEQ ID NO: 376 - protein, 1114 aa, unidentified; identical to SEQ ID NO: 366
  REGION 1..1114: note = Description of Unknown: uncultivated organism with predicted taxonomy: Coraliomargarita sp. CAG:312
  REGION 1..1114: note = MG2-60 effector

SEQ ID NO: 377 - protein, 1114 aa, unidentified
  REGION 1..1114: note = Description of Unknown: uncultivated organism with predicted taxonomy: Coraliomargarita sp. CAG:312
  REGION 1..1114: note = MG2-61 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 378 - protein, 1101 aa, unidentified
  REGION 1..1101: note = Description of Unknown: uncultivated organism with predicted taxonomy: Verrucomicrobia
  REGION 1..1101: note = MG2-62 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYFKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 379 - protein, 1114 aa, unidentified
  REGION 1..1114: note = Description of Unknown: uncultivated organism with predicted taxonomy: Coraliomargarita sp. CAG:312
  REGION 1..1114: note = MG2-63 effector
LASYSTKKNGATIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 380 - protein, 888 aa, unidentified; identical to SEQ ID NO: 367
  REGION 1..888: note = Description of Unknown: uncultivated organism with predicted taxonomy: Coraliomargarita sp. CAG:312
  REGION 1..888: note = MG2-64 effector

SEQ ID NO: 381 - protein, 1108 aa, unidentified; identical to SEQ ID NO: 369
  REGION 1..1108: note = Description of Unknown: uncultivated organism with predicted taxonomy: Coraliomargarita sp. CAG:312
  REGION 1..1108: note = MG2-65 effector

SEQ ID NO: 382 - protein, 1046 aa, unidentified
  REGION 1..1046: note = Description of Unknown: uncultivated organism with predicted taxonomy: Coraliomargarita sp. CAG:312
  REGION 1..1046: note = MG2-66 effector
LPSYSTKKNGAIIRAAEQENSFIFEVPYERAVFKFEPLILSLIPFKINDNNLRMSTTNLNNFNLSFDIGYSSIGWSISSKPANAVFPNWLGAGVVVFDDDSCMAKSRAEFRRMRRNIASKRNRIKRMREVLYGLGVMGKDELDNAKTEHPWFLAAETLASGKILSWSELWSVLRYYAHNRGYDGNSMWAKFGDDSDGDFEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKVYEPKLKLLGYESKNTAKSKLARNKAVIIIKGNFGVALANPPQIIPHHNVWQRLSELAEKNGGRFPKILR

SEQ ID NO: 383 - protein, 1114 aa, unidentified; identical to SEQ ID NO: 352
  REGION 1..1114: note = Description of Unknown: uncultivated organism with predicted taxonomy: Coraliomargarita sp. CAG:312
  REGION 1..1114: note = MG2-67 effector

SEQ ID NO: 384 - protein, 1114 aa, unidentified; identical to SEQ ID NO: 364
  REGION 1..1114: note = Description of Unknown: uncultivated organism with predicted taxonomy: Coraliomargarita sp. CAG:312
  REGION 1..1114: note = MG2-68 effector

SEQ ID NO: 385 - protein, 1114 aa, unidentified; identical to SEQ ID NO: 356
  REGION 1..1114: note = Description of Unknown: uncultivated organism with predicted taxonomy: Coraliomargarita sp. CAG:312
  REGION 1..1114: note = MG2-69 effector

SEQ ID NO: 386 - protein, 1114 aa, unidentified; identical to SEQ ID NO: 360
  REGION 1..1114: note = Description of Unknown: uncultivated organism with predicted taxonomy: Coraliomargarita sp. CAG:312
  REGION 1..1114: note = MG2-70 effector

SEQ ID NO: 387 - protein, 1114 aa, unidentified; identical to SEQ ID NO: 356
  REGION 1..1114: note = Description of Unknown: uncultivated organism with predicted taxonomy: Coraliomargarita sp. CAG:312
  REGION 1..1114: note = MG2-71 effector

SEQ ID NO: 388 - protein, 1114 aa, unidentified
  REGION 1..1114: note = Description of Unknown: uncultivated organism with predicted taxonomy: Coraliomargarita sp. CAG:312
  REGION 1..1114: note = MG2-72 effector
LASYSTKKNGAIIRAAEQENSFIFEVPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDMWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 389 - protein, 1108 aa, unidentified; identical to SEQ ID NO: 368
  REGION 1..1108: note = Description of Unknown: uncultivated organism with predicted taxonomy: Verrucomicrobia bacterium
  REGION 1..1108: note = MG2-73 effector

SEQ ID NO: 390 - protein, 1101 aa, unidentified
  REGION 1..1101: note = Description of Unknown: uncultivated organism with predicted taxonomy: Verrucomicrobia
  REGION 1..1101: note = MG2-74 effector
MDPANLALSFDIGYASLGWAVFLLKDPFPSLLGSGSVLFQKDSCLASSRRAFRRARRNIAARRSRVARLKKYLASLGVLEREQLDENACAYPWLLAARVLASDGKEKLSWQELWHVLRWYAHSRGYDGNALWAGDALDETGADDEDTQKVKAARALMEKYGKTTMAETVCADLQLEPFGEKRASRRYLKGNNAAFPRETVRDEVRRILLAHAGVLPKVDDALAATLLNDVPENLCAALRLPARFSAKGGLLFGQYVPRFDNRIIGHCRITGKNVPLKNCREYLLYRWGRLLNNLTVFARDGSIRTLSADKPNGRPSEREKLDAEMRSRGFFDKKKLNDLLKEITGCEPANTESYFLIPEMEDALILDPVRKLIATKKLVKDFWGYFSERGKKIFAAELAKGKTLKLSDCIKRMDGWGGWKTKPLFAAALEKLKAAEMKKKPEKRRNLLNLRIKAEFPTGRASYCREILKKTYEEALAGKDSTQPGGCLYETPEIRERLLRGNAVGDDAGTVATEQWLAGQTNNHMVRHRMLIFSRLLRDIIREYAEGDAARVKDVVVEVVRELKEFSGLSAQEIATKLNEKFANFNSVAEKIEAAAQEKGVSVSASLIRKARLLEDQGFACPYTGKNISYNELFSGALEIEHIIPRSLRPSDALSSCVMTFRAVNDMKGQRTAMQFMKECAGKDVPGTNLQIQPLANFKEWVEAHRSQKLRRGFSKEDQARCKRRAELLLVERYEERNADFTERDLTQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVPAKMHGLAVEQTTWSIVSQDEATRKVSLEQHTTDLKKGRYKDDGTRFVKNCEEKPALLLGFGVPEEQKSKLQAIKGVVKICENWGCALDPEPVVIPYFKVFPRLRELRERNGGKPVRVLRRGQQIEVLSGKFKGVWTIVSIKDATRDGILLDICAPDKVRQTEHGTTDSKVGVLLKSLLRAGLKILKPPLTGFACPTTSSQ

SEQ ID NO: 391 - protein, 1089 aa, unidentified
  REGION 1..1089: note = Description of Unknown: uncultivated organism with predicted taxonomy: Coraliomargarita sp. CAG:312
  REGION 1..1089: note = MG2-75 effector
VPYERAVFKFEPLILSLIPFKINDNNLRMSTTNLSNFNLSFDIGYSSIGWSISSKPANAVFPNWLGAGVVVFDDDSCMAKSRAEFRRMRRNIASKRNRIKRMREVLSGLGVMGKDELDNAKTEHPWFLAAETLASGKILSWSELWSVLRYYAHNRGYDGNSMWAKFGDDSDGDSEREANAEKLMADLGTSTQAETICAYLGVDAKSPKPLRFKKYFKGQNLAFPREIVFKEVERIIDAHIGILPKCDENFKKLMIGNWREVPSNIKLPGRFTSDRGLLFGQYMPRFSNRIITKCPLSGEKTPNCHSREFLDFRWKSLLANMAFPDGTDLMETRRKIDDFMLLYGALSKNALKKILKEVIGELPSNYNGMFLASEMEKALEVDPVRALILRTVYPNISFSLPNAELVEKLWKLIPKFVFTRMFRLKEYSFADICALLSPEKSAELAEFVRVIFDSSPASKKSPKPDFETAFNFKMRVQKISGRSPYSRQLMKSASEEIMRGVDPRSEGGSLYPRSESTKKEVLSNIDTWTNNHLVRHRLKIFKRLYMDIVREYCGADKSLVKSVAIEVVKDITAFSGLDSKKKAAKLNDLVAHHKSVSAYLKKEYPELSPNGSILRKARIADDLGWVCPYTGCHFSPRQLFESGNMEREHIIPRSLRPSDSLESLVITWKEVNDMKGQRTAYEFIKECQGMKVPGRQNLSIVTPERFEAFVRRLKKPMHPAGKADIERIKIRNKLLLTEHYKKREGGFLPSDLTQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLPRKMSGMDVEQTLWGVVKENENGTVTIRQYGAGKGESRRSIKKAYEPKLKLLGYESKNTAKSKLARNKAVIIIKGNFGVALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 392 - protein, 876 aa, unidentified
  REGION 1..876: note = Description of Unknown: uncultivated organism with predicted taxonomy: Verrucomicrobia bacterium
  REGION 1..876: note = MG2-76 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWQWKLAGRVLAGGKTLTWTELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFVKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 393 - protein, 1090 aa, unidentified
  REGION 1..1090: note = Description of Unknown: uncultivated organism
  REGION 1..1090: note = MG2-77 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWHELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 394 - protein, 1090 aa, unidentified
  REGION 1..1090: note = Description of Unknown: uncultivated organism with predicted taxonomy: Verrucomicrobia bacterium
  REGION 1..1090: note = MG2-78 effector
MSAKQNPPPDLSLSFDVGHSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 395 - protein, 1087 aa, unidentified
  REGION 1..1087: note = Description of Unknown: uncultivated organism with predicted taxonomy: Verrucomicrobia bacterium
  REGION 1..1087: note = MG2-79 effector
MNATQKIQPATNSDLQLAFDVGHSSLGWAVLQSSAGIPPAAKRTAGDNSINILSCGAVVFRADDCLASSRRTYRRQRRHIRSTKQRIARMKIILRHLGVLKENELNQPGCAWPWQLAARILQGGKLLTWPELWDVLRWYAHNRGYDGNRRWSAAEAEAQKEDSEKEANARTLMGKHGVHSMAETFCKELGVDPLGKKKSSMKRFKGLNAAFPREVVEGEVRKVLQAHSGKLKGVDVNLEKNLFSDWRAIPCPDLKLPKRYEDGLLFGQLVPRFDNRIISICPISGQKVPSRNCPEFLNFRWAMQLANIKVGKTKDRELQPLKTEYRVALDKQMRERGYLTPKELKDTVRSITSCERDNLDTMLMHPDAKEALLLDPVQKLICSNDLQPLWKLLPERLQKRLRGQWRHNKVFTLAQIRKQLESLGDVSAFDAEFQKQLDTQNSKAKKKEKQVTREQLLQQHFPSRPLKLDGRAAFARHLLKQAYEDVLAGKPHPKEEGGCLFITKKIREAQLNRAIADQTNNHLVRHRLLILERLLADIIKEYAAGDKKRVGKITIEVNRDLREMSGKTAKEKAQDLGLRIANHHAVAEKLEKAFAEERNGKSIPITAGLIRKARIAEDLGWRCPYTGIDYEPKDLVTKRVDKDHIVPRSERASDSLDSLVITLSAINKWKGKRTAWQFVEQEQGKPVPDLPNLSIVSLTRYKQFVESLETYKGHDDDKRRKKKRKELMLLPKYEEREFVPRDLTQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIPARMDGLRVEQNTWRVVSSDENGNVTIRQRIRQADGSRPEKLGEEKTTKLLGLKPANGNGKLAANKGVLVIPDNYGVALDPLPTIIPFHKVWPRLQELKKANGGKLPRVLRNGQTIKVPEGKYKGVWRIFSAKNNATGMAIDIGQPDVVRLKNKTEGHKINVLLTSLLKNKMEVVKTPFTGISAIPATSST

SEQ ID NO: 396 - protein, 974 aa, unidentified
  REGION 1..974: note = Description of Unknown: uncultivated organism with predicted taxonomy: Verrucomicrobia bacterium
  REGION 1..974: note = MG2-80 effector
DVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDINEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 397 - protein, 851 aa, unidentified
  REGION 1..851: note = Description of Unknown: uncultivated organism with predicted taxonomy: Verrucomicrobia bacterium
  REGION 1..851: note = MG2-81 effector
MSPKLEFSFDVGHSSIGWAVLQSSAVVSPVANAPRVNILGCGVVTFGADDCLASKRRDYRRQRRHARSTRHRIAQLEKLLAHLKVLSADQLKQKHQQAGGHAAPWFLAARVLASNGAAKYLLDWPQLWDVLRWYAHNRGYDGNRRWSAQEAEAQSEDTEKEKTANALMEKHGTTTMAETLCKALGLEPLGDKQSSKENFKRLNAAFPRSIVEKEVRRLLELHQKKLPAITDTFLKSLFEDWRAAKISDLKLPDRYQGGLLFGQLVPRFDNRIISTCPITGEKVPSKNCPEFLKFRWAMTLANIRVAGAKEKELRPLAADERKKINVVMESEGALTPRELTKLVRETTGCTRDNLDTMLMHPDAKDGLLLNPIQKLVQGDKLKTLWPTFSPRVQKRARDLWERGKPVTLEHICGIAKKLGESLANFEAKLNKLADSANTKRSKKAGSLDSEALLKEPLTIKKSDGRAAYARPLLVRAYAEVMAGKHPKEDGNSLCVTEEMRQAQLQKQIDQQTNNHLVRHRLLILERLLKDLIADSAFANGDKSRIARTTIEVNRDLREMSGKSAKEIQQDLGRRLANHHGVAAKLDADLDGRTFNGKPIQITAGLIRKARIAEDLGWTCPYTGKTYDAIDLVSRQVDKDHIIPRSLRPSDSLDSLVVTFAEVNKMKGQRTAWKFVSDEQGKVVEGSPQLSIVSLTRFKQWAESLETYKGHDDDKRRKKKRKELLLLPNYEEKGFVPRDLTVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEKAL

SEQ ID NO: 398 - protein, 1082 aa, unidentified
  REGION 1..1082: note = Description of Unknown: uncultivated organism with predicted taxonomy: Verrucomicrobia bacterium
  REGION 1..1082: note = MG2-82 effector
PDLSLSFDVGLSSIGWAVLQTSPDVEIKGCGVVIFRADDCLASARRGYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 399 - protein, 1075 aa, unidentified
  REGION 1..1075: note = Description of Unknown: uncultivated organism
  REGION 1..1075: note = MG2-83 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIPARMDGLRVEQNTWRVVAVKDGEVILKQRIRQPDGTRPEKIAEEKPGKLLGLNPTNGNGKLAANKGALVIPDNFGVALDPQPIVIPFHKVWTRLQELKKANAGKLPRVLRNGQLIRVKDGTYKGVWRVFSAKNNATGMALDIGSPDVVRLKNKTEGHKINVLLSSLIKGGLEPIQSSFTGITSK

SEQ ID NO: 400 - protein, 938 aa, unidentified
  REGION 1..938: note = Description of Unknown: uncultivated organism with predicted taxonomy: Verrucomicrobia bacterium
  REGION 1..938: note = MG2-84 effector
VYHNGDMASRRNAPDLQLAFDVGHSSIGWAVLQANPDVEIAGCGVVIFRADDCLASARRGYRRQRRHIRSTRQRIKRMKALLLHLGVLTQTQLDKSGCAWPWKLAARVLVGGKTLTWPELWDVLRWYAHNRGYDANRRWSAAEAEAEKEDTEKLENAKTLMDKHGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRL

SEQ ID NO: 401 - protein, 1090 aa, unidentified
  REGION 1..1090: note = Description of Unknown: uncultivated organism with predicted taxonomy: Verrucomicrobia bacterium
  REGION 1..1090: note = MG2-85 effector
MSAKQNPPPDLSLSFDVGHSSIGWAVLQTSPDVEIKGCGVVIFRADDCLASARRVYRRQRRHIRSTRQRIKRMKALLLHLCVLTQAQLDKPGCAWPWKLAGRVLAGGKTLTWPELWDVLRWYAHNRGYDGNRRWSAGEAANEKEDQEKVQNAHALMREHDKQTMAETFCAVCGIDPMGAKCSSNIDPAKRFKAKNAAFPRGIVEAEVARLLRTHFGKLKGVDEKFATAMFSDWRALSCPAIKLPIRYQGGLLFGQLVPRFDNRIISKCPITGQKVPSRNTREFLSYRWGMLLANVRVARLADRELKPLTVEERKELDKLMRAEGSMTAKQFTEAVEKVAGSIRHNLSTMLMHPDAKDALVLDAVQECLTTEKPMPVKALFAALPTRIQKRARGQLRRGQSFTFAALYEAAKQAEELVAAFDAAVQQQLDKAAGKGRKKDKPLTRDELLAKSLSVRKLSGRAAYARPILVQAFAEVMNGKHPKEEGGCLFVTEKMREAQLNRTLAQQTNNHLVRHRLLILARVLKDIIEEYAGGDKKRVGKMTIEVNRDLREMSGKTAKEKAQDLGLRLANFKSVVKKLEEAFEGKQIRITPGLIRKARIAEDIGWVCPYTGEHYDAFDLLHKNVDLDHIIPRADRPSNSLDSLVVTFPEVNRMKGKRTALAFMKEAETKQVEGLPRLTLKSLNHFKADIEALRPGSDPRKAKRRGAVTGPIDDDLRRWKRKELLLKVEKWDGGDFLPADLTVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIPKRITGLRVEQNTWRVQSIEDGDVTLTQRIRQPDGKRPRKQVIQRSGKLIGLEPGKLQTLKGALVIGENFGVALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 402 - protein, 985 aa, unidentified; identical to SEQ ID NO: 326
  REGION 1..985: note = Description of Unknown: uncultivated organism
  REGION 1..985: note = MG2-86 effector

SEQ ID NO: 403 - protein, 909 aa, unidentified
  REGION 1..909: note = Description of Unknown: uncultivated organism with predicted taxonomy: Methylococcales bacterium
  REGION 1..909: note = MG2-87 effector
LENAKTLMDKPGVKTMAETFCKELGVDPRGAKSSSMTRFKGLNAAFPRGVVEAEVARILQAHFGKLKGADEKFAAALFSDWRAIPCPKIKLPQRYQGGLLFGQLVPRFDNRIISICPISGQKVPSRNTPEFLNFRWGMLLANVRVARLVDRELKPLTVEERRELDRLTRAEGAMTAKQFTDAVEKVTGAIRHNLATMLMHPDAKDALVLDPVQKLVTTGHRAALWPTLPERIQKRARGQLRRGKPVTLGDLGNEVPAFHAQVQSILDKTAGRGRKKDKALTRDDLLREILQVRKLDGRAAYSRPILRKAFEQVMDGKHPAEDGGCLFVTEQTRQAQLSRSLTQQTNNHLVRHRLLILSRLLNAIVKEYADGDKTRIGKMTIEVNRDLREMSGKTAKEVAQDLGLRLANFKNVVKKLEGDESFMRELNQRGLHHIPPGIIRKARVAEDLGWRCPYTGMEYEPVHLLTRRVDKDHIIPHADRASDSLDSLVITFSAINAMKGKRTALQFVNEEQGKTVEDLPNLSIVSVNRYREFVEGLEAFRGHDDDRRRKKRRKDLLLLPSYEEKEFTPRDLTVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIPKRIAGLRVEQNTWRVRGSKDGDVTLQQRIRQPDGKRPLKQAVERASKLIGLEDGKLHRLSGALVVGENFGVALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 404 - protein, 985 aa, unidentified; identical to SEQ ID NO: 326
  REGION 1..985: note = Description of Unknown: uncultivated organism
  REGION 1..985: note = MG2-88 effector

SEQ ID NO: 405 - protein, 985 aa, unidentified; identical to SEQ ID NO: 326
  REGION 1..985: note = Description of Unknown: uncultivated organism with predicted taxonomy: Verrucomicrobia
  REGION 1..985: note = MG2-89 effector

SEQ ID NO: 406 - protein, 807 aa, unidentified
  REGION 1..807: note = Description of Unknown: uncultivated organism with predicted taxonomy: Verrucomicrobia bacterium
  REGION 1..807: note = MG2-90 effector
MSIKGKISNGADANLQISFDVGHSSIGWAVLEKTGQQVSDIKINGCGSVVFRADDCLASSRRAYRRQRRHIRSTRQRIARMKILLKHLGVLTEKELDKPGCAWPWKLAAQILQGGKLLTWPELWDVLRWYAHNRGYDGNRRWSAAENDAQSEDSEKEENARSLMGKYGTKSMAETFCAISGINPLGEKKSANLSGDKRPKGQNAAFPREIVELEVRQILQKHFGKLKNADENLEKVLFTDWQTISCPDLKLPKRYEGGLLFGQLVPRFDNRIISTCPISGQKVPTRNCTEFLNFRWAMQLANIRIACAGEKELRPLTAAERKIIDQAVSEKGGVTPFQLKLIVREKTKCVRDDLEQMLMLPDFEKALLLNPIQKMISADDFQPYWKLLPDRLQKRLRGKWRRGKVFSLAQIRTQLESLGDASAFDAELQRQLDAHNSNAKKKDKQITRENLLQKHFPSKPLKLDGRAAFARHLLKQAYDEVLAGKDPNGKGGCLFRSEEIRQKELNREISDQTNNHLVRHRLLILERVLNDIIKEYAGGKKDRIGKITIEVNRDLREMSGKTAKEKAQDLGLRIANHHNVAEKLEKAFAEEGIKQTITAGLIRKARIAEDLGWHCPYTGIQYEPKDLITRRVDKDHIVPRSERASDSLDSLVVTFSAINKWKNKRTAWQFVTDEQGKTVPDLPNLSIMSLARYKQFVESLESYKGHDDDKRRKKKRKELMLLPKYEEKEFMPRDLTQTSQLVRLGAQVLKKNLPHLTTGDVTSLPGSVTGTVRKGWKLEACLGLANPQVFDGNGGAKTKTEIRDITH

SEQ ID NO: 407 - protein, 1075 aa, unidentified; identical to SEQ ID NO: 399
  REGION 1..1075: note = Description of Unknown: uncultivated organism
  REGION 1..1075: note = MG2-91 effector

SEQ ID NO: 408 - protein, 774 aa, unidentified
  REGION 1..774: note = Description of Unknown: uncultivated organism with predicted taxonomy: Verrucomicrobiae bacterium Tous-C5FEB
  REGION 1..774: note = MG2-92 effector
ELWDVLRWYAHNRGYDGNQRWSNREMIRAFNSEGLHQTSKPSADDEKSLVAAAEKADAEAGVQNEADSDVKKVKEAFKQMHDYGTSTMAETMASHIAKFEIQAAEHRLGKRQEKPTRFKGLGAAFPRRIIRVINNEQTLAGGVEWEVRYILRAHFGHLPNCDANFERAICGGLPESKFDWRAYEQSHPTLYLTSKAEKLKLRELRIPRKADKQTKADKKKLRTEFLRNKLVLSSHFEGGVLFGQAVPRFDNRIISICPITGEKVPSKNCREFLKFRWAMMLANIHVAGAKEKELHPLTGDERKKINAVMENEGALTPTTLKRSVRETTNCTRDNLEMMLMHPDAKDALLLNPIQKLVRSEKLKTIWPTFSYPVQKRARDLWLRGKLVTLERICGIAQKLGESLTGFEAELNKLADVANTKRGKKESSFNREALMREPLTIIKLDGRAAYARPLLVRANAEVMAGKHPKEEGGCLEVTDAMRQVQLQKQIDQQTNNHLVRHRLLILERLVKDLVAEPAFASGDKSRIAKCTIEVNRDLREMSGKSSKEIQQDLGRRLANHHGVAAKLEKDLDGRTFNGKPIQITAGLIRKARIAEDLSWMCPYTSKAFDAIDLVSRQVDKDHIIPRSLRPSDSLDSLVVTFAEVNKMKGQRTALQFVSDEQGKTVEGSPQLSIVSLTRFKQWAESLETYKGHDDDKRRKKKRKELLLLQTYEEKGFVPRDLTVTSQLVRLGAQIIKKTFAENEKLPTVVSLPGSVTGTVRKGWNLLGCLATAAPQ

SEQ ID NO: 409 - protein, 1081 aa, unidentified
  REGION 1..1081: note = Description of Unknown: uncultivated organism
  REGION 1..1081: note = MG2-94 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVASIKDNADGICLDINAADKIKIENGSVDSKINVRLNSLLNSGLKILKPKLTGTCPTTSSP

SEQ ID NO: 410 - protein, 1081 aa, unidentified; identical to SEQ ID NO: 409
  REGION 1..1081: note = Description of Unknown: uncultivated organism
  REGION 1..1081: note = MG2-95 effector

SEQ ID NO: 411 - protein, 1080 aa, unidentified
  REGION 1..1080: note = Description of Unknown: uncultivated organism
  REGION 1..1080: note = MG2-96 effector
MKQGQIAFSFDIGHSSIGWAAFQVSDAPGTFHSLLGTGVVLFPKDACLASARRGFRRSRRNIAARRSRIDRLKNYLAGLGVLSRDQLDANSNSYPWLLAARILASDGKKTLTWEELWSVLRWYAHNRGYDGNALWAGDDADAGDKEDTDKVKNSIALMEKHKTATMAETVCKALGLDPMGEVKASRIYFKGNNAAFPRGVVTEEVRRILAAHAGKLPKVDDALSDILLRNAATSGLELPARFKGGLLFGQYVPRFDNRIIPACRITGKNTPLKRCPEYLLYRWGRLLNNLTVFGADGQIRTLLPAERQALHSRMEADGFFTKRTLNAALKDVTGCTPANTESFFLTEEMEEALVLDPVKKLLATNQIMKDLWPQLSAESREKAQSSLSAGKKIRLGDILAEMETAGQDTTAASDALASHQKKAKKKNADLATRRLSADYPKGRAAYCREILAKTFDESISGKDSTKEGGCLYETEEIRNRLLREPLVQQTNNHLVRHRLLVFERLLAHMVEEFAGGDEKRIAATVVEVVRELQEFSGLNSKEITHKLNEKLGNFRSVVKNLEEAIANSEERVAITGSLIRKARILEDQGFVCPYTGTHLSYNHLLADRLEIEHIIPRSLRPSDALSSCVMTFRSVNDMKGQRTAMQFICEEQGREVPGHENIQITTKKAYVDYVAKHKKQYPQKSDDRRRCERRAELMLMERYDQRNADFTERDLTQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIPAKMHGIIVDQTTWGIVAAGAITTLRQKTTEKNARCDENGKRFIKTTEKKRSLLLGGPDAPDGKLAKIKGAILVTENWGCALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 412 - protein, 953 aa, unidentified
  REGION 1..953: note = Description of Unknown: uncultivated organism with predicted taxonomy: Acidobacteria bacterium RIFCSPLOWO2_12_FULL_68_19
  REGION 1..953: note = MG2-97 effector
MKQDQIAFSFDVGHSSIGWAVFKIADTPESFHTLLGTGVVLFPKDSCLASSRRGFRRSRRNIAARRSRIDRLNNFLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGADGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAQLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAFEAYVAKHTKQYRYGTDDRRRCERRAELMLMERYDQRNADFTERDLTQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIPAKMHGIVVDQTTWGIVAAGTITKLRQKTTEKNARCDENGHRFVKTIEEKRSLLLGGPNAPDGKLA

SEQ ID NO: 413 - protein, 1101 aa, unidentified
  REGION 1..1101: note = Description of Unknown: uncultivated organism with predicted taxonomy: Verrucomicrobia bacterium
  REGION 1..1101: note = MG2-98 effector
MTRREKSATAKFITFSFDVGHSSIGWAVLGSGQKRPSIQDAQILGCGVVTFPVDDCLANQRRDFRRQRRHIRSTRLRIERMKRLLLHLGVMTREQLDKPGCAWPWLLAAQAFHGLRTLTWPELWDVLRWFAHNRGYDGNRAWSRFEEEEPEDTERVGQGRALLIEHKTQSMAEVFCHVLGINSRDPAAQKSSRKRIREVLQAAFPRETVKAEVSAILKNHEGKLPKCDDKLATALLTDRKAIDCPTVKFPLRYIWGYLFGQLAPRFENRILTRCPFTDEKVPAKDCPEFYRFRWAMQLANVVVDEDGNSRPLTQTERQAVNARMAECGALTKSEFKKAVADATGGRPNNLETMLMHPDAEKSLVLMPARKTALSGKNKDVFNLLPSALQARLLGKLIRRGSVRLRDIRSWTENDPALLAKFDAVISSWKTKAAGREKTKLDEDETQDPLDRTWKAHPESGRAPFARPILQQAYDDVMAGKDPRMEGGILYRSEEVLRRERDRTLAEQTNNHLIRHRLLILQRLAKDLLKDYAGGKASRIVKAIIEVNSDLRTMSGMTAKERETEMKKRLSNFTSAKIALEKALTGKKIGGKPIPITAGLIRKARLAMDLDMTCPYTGQIYDFIDIAKGRMQRDHVIPYAERASDSLAAQVLTFAEVNKWKDKRTAAQFVREEQGKAVKGKPNLVVLPFEKYKAFVEGLDKGKHPHPDDKARKEKRKKLLLLEEYAEKEFLPADLTITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVSADMAGLKADQAVWRVVDFKDNHPSAQKLVRAIRIAKLDKDMAEDMAFLAHWKRKGKGVERPKNLLKETESYFVEYDIVPKAKLMGLQPGKLQELKAVKVISENYGLALDPKPEIIPFAQVWRRLAELRAENDGKPVRVLRKGSLFRVGQGKFAGEFKVFSIKKNHNGLSLDIGPRDIPRPLNKMTAQGHYINVLLSSLLKGGLEIMDTDYAMN

SEQ ID NO: 414 - protein, 1080 aa, unidentified; identical to SEQ ID NO: 411
  REGION 1..1080: note = Description of Unknown: uncultivated organism
  REGION 1..1080: note = MG2-99 effector

SEQ ID NO: 415 - protein, 1038 aa, unidentified
  REGION 1..1038: note = Description of Unknown: uncultivated organism with predicted taxonomy: Proteobacteria
  REGION 1..1038: note = MG2-100 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMVAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFICDCEKHGRDVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIPAKMHGIVVDQTTWGIVASGAITKLCQKTTEKNARYDENGRRFVKTAEEKRSLLLGGPNAPEGKLARIKGAILITENWGCALDPAPPTVIPHFKVYPQLRALREKNGGRPVRILRKGSLIQIKTGRFQGIWSVAYIKDNADGICLDIN

SEQ ID NO: 416 - protein, 916 aa, unidentified
  REGION 1..916: note = Description of Unknown: uncultivated organism with predicted taxonomy: Bradyrhizobium
  REGION 1..916: note = MG2-101 effector
MKQDQIAFSFDVGHSSIGWAVFKIADTPESFHTLLGTGVVLFPKDSCLASSRRGFRRSRRNIAARRSRIDRLKNYLVGLGVLSREQLDTNSNSYPWLLAARVLASGGKKALTWEELWSVLRWYAHNRGYDGNALWAGDAADAGDKDDNEKVQNAIALMDKHKTGTMAETVCKELGLDPRGEVKASRIYFKGNKAAFPREVVTEEVRRILAAHVGKLPKVDDALSDVLLKNAAPAGLELPARFKGGLLFGQYVPRFDNRIIPACRITGKNVPLKKCPEYLLYRWGRLLNNLTVFGTDGQIRTLLPAERKALHARMEAEGYFTKRTLNAALKEATGCTPANTESYFLTEEMEEALVLDPVKKLLATNQVLREVWPHLSAESRTQAQSALAAGKKIRLADILAAMESAGQDTAAAREALAHLQKKAKKKDADLVAHYFKANYPTGRAAYCREILAKTFAESMAGKDSTKEGGCLYETEEIRNRLLREPLVKQTNNHLVRHRLLIFERLLDQMMAEFADGDKKRIGATVVEVVRELQEFSGLNAKEVAQKLNEKLGNFRAVVKGLEEAIRGSGEKVAITGSLIRKARILEDQGFICPYTGAPLGYPDLLNDRLEIEHVIPRSLRPSDALSSCVMTFRSVNDMKGQRTAMQFIGEEQGREVPGHGNLQITTKKAYEAYVAKHKKQYRYGTDDRRRCERRAELMLMERYDQRNADFTERDLTQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIPAKMHGIDLKQTTWGVVTSGAIKKLRQK

SEQ ID NO: 417 - protein, 1088 aa, unidentified
  REGION 1..1088: note = Description of Unknown: uncultivated organism with predicted taxonomy: Methylococcales bacterium
  REGION 1..1088: note = MG2-102 effector
MNEKQKISPVTVPDLQLAFDVGHSSIGWAVLQNNTGISPATAKPGNDNRSINILGCGSVVFRADDCLASSRRAYRRQRRHIRSTKQRIARMKIILNYLGALTENELNQPGCAWPWQLAARVLQGGKLLTWPELWDVLRWYAHNRGYDGNRRWSAAEAEAQKEDSEKEANARTLMGKYGVHSMAETFCRELGVEPLGKKKSSMKRFKGLNAAFPREVVEGEVRNILQAHSGKLKGVDVNLEKVLFSGWRAIPCPDLKLPKRYEGGLLFGQLVPRFDNRIISICPISGQKVPSRNCPEFLNFRWAMQLANIKVGKVKDRELQPLKVEHRSALDKQMRERGYLTPKELKDAVRSIAGCERDNLDTMLMHPDAKDALLLDPVQKLICSDDLQPFWKLLPERLQKRLRGQWRRGKVFSLTQIRKQLELLDDAGAFDSKLQKQLDTQNTKAKKKDRQVTREELLQKHFPSRPLKLDGRAAFARHLLKQACEDVLAGRPHPKEEGGCLFISEEIRQKQLNREIAEQTNNHLVRHRLLILERLFGDIIKEYAAGKKGRIGKITIEVNRDLREMSGKTAKEKAQDLGLRIANHHAVAEKLEKAFAEERNGKSIRITAGLIRKARIADDLGWKCPYTGQPYEPKHLITRFVDKDHIVPRSDRASDSLDSLVITFSAINKWKGKRTAWQFVSEEQGKPVPDLPNFSILSLARYKQFVETLETYKGHDDDKRRKKKRKELMLLPKYEEKEFVPGDLTQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIPARMDGLRVEQNTWRVVSSDENGNVTIRQRIRQPDGSRPEKVGEEKATKLLGLKPVNSNGKLAANKGVLIIPDNYGVVLDPVPTIIPFHKVWPRLQELKKANGGKMPRVLRNGQTIKVPEGKYKGVWRVFSAKNNSTGMAVDIGQPDVVRLKNKTEGHKINVLLASLLKNKMQVVKTPFTGIASCPTTSPA

SEQ ID NO: 418 - protein, 961 aa, unidentified
  REGION 1..961: note = Description of Unknown: uncultivated organism with predicted taxonomy: Verrucomicrobia bacterium
  REGION 1..961: note = MG2-103 effector
YDGNQRWSKNASSESESHTLDDASLDKILSDASATEADKDDAKKVKEAKNLMQKNGTHSMAETFCKELGLHPMGKAKASMKRFKGLNAAFPREIVEGEVRRILKAHFGKLPKVDAHFERVLLGKDNQDKLAWQAIPCPELKLPKRYQGGLLFGQLVPRFDNRIISTCPISGEKVPSRNCPEFLNFRWAMQLANVQVARFGEQKLSPLKPDERADLDKQMRAAGGMTAKQFTEAVRSTTSAIRDNLDTMLMHPDAKEALLLDPVQKVVCSDDLAPFWKLLPERLQKRLRGKWRHGKVFTLAQIRTQLELLGDATAFEVELQNQLDTRNTKTKKKDKQVSREELLQKHFPSKPLKLDGRAAFARHLLKKAYEEVLTGKHPKEEGNCLFLTEEIRKKQQEREIADQTNNHLVRHRLLILERLVGDIVKEYAGGDKEQISKATIEVNRDLREMSGKTAKEKAQDLGLRIANHHAVSDKLEKAFAEEGKRTPITAGLIRKARIADDLGWKCPYTGQDYEPKQLVSRYVDKDHIVPRSQRASDSLDSLVITFGAINKWKGNRTAWQFVEQEQSKPVPDLPNLSILTLTRYKQFVESLETYKGHDDDKRRKKRRKDLLLLPKYEEKTFVPRDLTQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVPARMDGLRVEQNTWRVVSIKDGEATIQQRIRQADGSRPLKQTEEKVGKLLGLEPGKLSANKGALVIPDNFGVALDPQPTIIPFHKVWTRLQELKKANSGKMPRVLRNGQIIQVPTGRYKGIWRVFSAKATLTLDLGSPDKVRLESKGDGQKREVQIKTLLQDGMVFQKIPLTGIAACPTTSSS

SEQ ID NO: 419 - protein, 1011 aa, unidentified
  REGION 1..1011: note = Description of Unknown: uncultivated organism with predicted taxonomy: Verrucomicrobia bacterium
  REGION 1..1011: note = MG2-104 effector
DAVPDTEKVKNAGELAHDLGTETMAETIAAYTVRYEAAMQAWHRARTAAVTEGKEFKEPKPMVHFKGRNCAFPRESVVWPEVQRLLTALKGKLLNLDDALIRALLGNDVDPLKDREAWKTLPCPALKLPKRYHGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDHAPEGEEKFVVIPWHRVWHRLEELKERNGGNRPMLIRNGQLIRVAKGNYAGVWRVFSAKNNTSGMALDIGWPDVVRLQNKTEGHKINVLLASLVKAGLEALPNSLLGLDSRAVCQTAT

SEQ ID NO: 420 - protein, 762 aa, unidentified
  REGION 1..762: note = Description of Unknown: uncultivated organism with predicted taxonomy: Verrucomicrobia bacterium
  REGION 1..762: note = MG2-105 effector
HGGLLFGQMIPRFENRIIGVCPIQFARLEARYLSEGLDAAEAKHRAAKEAKLPAKATPEFLRFRWAMQLANVFGAAPGESKTRPLSAEERRKLTEQAEQRGAFGKVEFKKAVRAVTGWLDKPARDNLDSLLLHPDAERALELDPVQNEIRKSSLRPALDALPDRYRKRLHGKLASGKTVTLAEVRGWLEAGSRRREEAESLAAFDAVLDQEVEKANTKRGKKQEATTRESLLAEKLTAAFPTGRAPYARPILRQAYEEAMSGIDPRAEKSADQPRGVLCQTDELKEAQLHRRLDEQTNNHLIRHRLLILERLLEDLIAAPEFADGDKARVAGLTIEVNRELRDLSGKTRKEQEKDLGIRLKDFKDVAKKVEDACKRRGVSITAGIIRKARVAEDLGWKCPYTGKAFEIDALLGDTMDKDHIIPHADRQSDSLDSLVMTWKEVNTWKGKRTAMQFIREEGGKTVPGRPELSIMPLEPFKKHVASLDTRKGHNDDKARKKRRVQRLLTENYEEKEFTPRDLTVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVPADMGGVLVEENTRGIQGISEDGRRVALRQRAPRDPKTGVRPSAKTTDEAAGKLLGLQPEGGSGKLKRQNGVRVITDNFGVAILDH

SEQ ID NO: 421 - protein, 1134 aa, unidentified
  REGION 1..1134: note = Description of Unknown: uncultivated organism with predicted taxonomy: Rothia
  REGION 1..1134: note = MG3-6 effector
MSTDMKNYRIGVDVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 422 - protein, 1131 aa, unidentified
  REGION 1..1131: note = Description of Unknown: uncultivated organism with predicted taxonomy: Rothia
  REGION 1..1131: note = MG3-7 effector
MSEHTKYRIGIDVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGASDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 423 - protein, 1132 aa, unidentified
  REGION 1..1132: note = Description of Unknown: uncultivated organism with predicted taxonomy: Rothia
  REGION 1..1132: note = MG3-8 effector
MSTDMKNYRIGVDVGDRSVGLAAIEFDDAGFPIQKLALVTFRHDGGLDPTDNPKSRKETRGEARRRMRMTRRRKQRLRDLDKVLENLGYTVPEGPEPETYEAWTSRALLASIKLASADELNEHLVRAVRHIARHRGWVNPWWSLDQLERASQEPSETFEIILARARELFGERVPANPTLGMLGALAANNEVLLRPRAEKKKKTGYVRGTPLLAAQVRQIDQVAELRRICEVQGIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKRTEARQWWEANDDDQLRSLFIMFLADATNDTEEAAAVAGLPELYMSWPAEEREALSNIDFEKGRVAYSHETLSKLSEYMHEHRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 424 - protein, 1050 aa, unidentified
  REGION 1..1050: note = Description of Unknown: uncultivated organism with predicted taxonomy: Dermabacter hominis
  REGION 1..1050: note = MG3-1 effector
MRKRKRQRLKALDRYLAEHGYPDVQPQITPYDAWHARARLVSTKVDDPAQLKNDLALALRHIARHRGWRNPWKTLASTRKLPVPSETLLANQARAREHFGDEVNDSTTVGQIGALAASRDYLLRPRNITVTKGVNQKKNVNDLERSSEEALAAGHPTAPILGWQVRQEDQINEVERIWERQGLPSEELPQILTLLFAQTKPHVPSERVGRDALQPKLYRAPIAALEFQDFRILAAIANLRVRTEGGRRLTKDERFTAFQFMSGWREKEPLSWADVAEELGFSAHALAAPTTETNQRLAFAPTNRTLTTLGTFFKGKKIDAGAREWWQSASYAERSLLAQLIADATPDTQEQADASGLSDVLLQWDEDTVADLMELDLQSGRAAYSTDTLLRLNARMENDGTDLFESIQAEFNIDPSRLPRPDWDDQTGQPTVDRVLTIVRRFVGGCERKYGKPESVTVEHVRTGLMGAEQRSSIIAENNRNRRDSDRIRAELQADGLSEPSRLDVRRHRQVQRQNCTCLYCGTPITTTTSELDHIVPRRGGGSSQGSNLVAVCRECNASKAHRIFAEWAEDSQREGVSVKEAAKRVRHWLNASASMKREVTRRLQQKRTDPPIDERDLASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRKSRGAVHDATVMKALERDLWGEWDAQAIDRLVDPELHLALRKLFTSTKSKKIDVDATSQGLPERYLANQTVQLFDADAPSVMSPRGILRIGAGTHHARLLTWDDPKKGPQLGIQRVFAAEFGEILKDASSNDLFEAPIPFHTMSHRDLQPKVRAAVEQGLTRQIGWITQGDELEIDPADFVGEANAFGNFLREFPERSWSIAGLKKSNTIVIRPLLLSQEGVTAAISPHAAKIVENGIELSNSTLFTAPGTGIIRRTGLGRPRWDSGPAHLPESFNVHARMTQQSARD

SEQ ID NO: 425 - protein, 1134 aa, unidentified
  REGION 1..1134: note = Description of Unknown: uncultivated organism with predicted taxonomy: Micrococcales
  REGION 1..1134: note = MG3-5 effector
MCINGDSMAAVSGFSPCKFGIGIDVGDRSVGFATIEFDDDGFPLSVLASVSYKHDGGLDPTKNKNPISRKATAGVAHRVRRMRKRRRRRLEMLDVKLRSLGFPVPNGEEPQTYQAWQSRAKLIDGRVDEVRELNDHLVRAVRHIARHRGWRNPWWRFPQLLEASENPSDALVAMRREAAQRWPGQALESATIGQLGWLGAHPDVLVRPRSARSEVPVLSSRVMQQDQCAEIRRYWQLQDLPQEALHPILKAVFHQEPPTVPAERIGRDALPGQDAPRAIRAALEFQEYRIRDAVANLRVRTGGANRKRKLTPEENHAVVKYLMEFRQNPSPSWAEVAEHIDIAPTSLIAPIIDDMRIAAAPTDRSTITAEAVLSNMKKDSGARLWWESADQKMRSLLIRFLADTSDYTQPEAEMAGLVDIVSTWPDSEIEKLSSASWQSGRAAYSLQSLERMNAYMAEYSTGAHEARKGVFGVDDSWKPEADPWDAQTGQPVVDRVMTIVRRFVGACERKWGEPERIVIEHVRTGLMGPAQRAEVLREMASGRRKNDRIRQELRTSGIDEPNLSDVKRHRKIQMQGGVCLYCGTDITSATAELDHIVPRAGGGNSTSTNLVAVCRVCNAAKGRRTFPEFASSDTRDAVSLEAAVERVKLWIDDKGIKNIGESRYARDVIRRLKQSTQDEPIDERSLSATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISPSNGAVHDDSVRPLTRQKIDSTWDRKSINRIVDPEIHVAMRRLLNNGTSLPEDKNRVLDLPDGNELGPHDEVELFSTSAASIKLRRGGSAEIGGSIHHARVYAWMGAKGQLEYGMMRVFGAEFPTLTKLSGSKDILRMPIHAGSMSYRDMQDRVRKPIESDIAVELGWITQGDELEILPEAHLETAGGLGDFLKSFPETQWTIDGFNDPSRLRVRPRLMSLEGRDTIDAMGHLSDTEKLKIKQALSKGLMVSASELLSHGAKIIRRDHLGRPRWRGNARPVSIELEQVANQLVNHRSVDGQ

SEQ ID NO: 426 - protein, 1132 aa, unidentified
  REGION 1..1132: note = Description of Unknown: uncultivated organism with predicted taxonomy: Rothia
  REGION 1..1132: note = MG3-6 effector
MSADSLNYRIGVDVGDRSVGLAAIELDDDGFPLKKLAMVTFRHDGGKDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRPQNGSVHKDTVEAVLERTVGDSWTDKQVSRIVDPNTYIAFLSLLGRKKELDADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 427 - protein, 1134 aa, unidentified
  REGION 1..1134: note = Description of Unknown: uncultivated organism with predicted taxonomy: Rothia
  REGION 1..1134: note = MG3-7 effector
MSTDPKNYRIGVDVGDRSVGLAAIEFDDAGFPIQKLALVTFRHDGGLDPTKNKTPVSRKKTRGDARRTMRMNRRRKQRLRDLDMMLTNLGYTVPEGPEPETYEAWTSRALLASIKLANVDELNEHLVRAVRHMARHRGWANPWWSIDRLENASREPSETFEIILARARELFGEKVPADPTLGMLGALAANNEVLLRPRDGKKKKTGYVRGTPLLVAKVRQEDQLAELRRICEIQGIEGQYDALRSAIFTHKMAYVPTERVGKDPLNPSKNRTIRASLEFQEFRILDSVANLRVRTDSRSKRELTEAEYDVAVEFLMSYTANEQPSWADVAEVIGVPGNRLIAPVLEDVQQKTAPFDRSSAAFEKAMGKKTEARQWWESTDDDQLRSLFISFLVDATDDTEEAAAEAGLPELYMSWPAEEREVLSDIDFEKGRVAYSQETLSKLSEYMHEYRVGLHEARKAVFGVDDTWRPPLDKLDEQTGQPTVDRVLTILRRFVLDCERQWGRPRAITVEHARTGLVGPAQRQEILNEQKKNRENNELIRGDLRKSGVENPSRAEVRRHLIVQEQESQCLYCGAVIRTDTSELDHIVPRAGGGSSRRENMAAVCHYCNSKKKRTLFYDWAGPVKLQETVDRVRQLEAFKDSKKAKMFKNQIRRLKQTEADVPIDERSLASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRPQNGSVHDDTINAVKKLTLGSAWPADAVKRIVDPEIYLAMKDVLGKLKELPEDSARSLELSDGRYIEADDEVLFFPKKAASILTPRGAAEIGNSIHHARLYSWLTKKGELKFGMLRVYGAEFPWLMRESGSRDVLHMPIHPGSQSFRGMQDGVRKAVESGEAVEFGWITQDDELEFDPEDYIAHGGDDELNRLLRVMPERRWRVDGFYNAGTLRIRPALLSAEQLPSELQKKVADKTLSDVELILLRAVQRGLFVAISSFLPLESLKVIRRNNLGFPRWRGNGNLPTSFEVRSSALRALGVEG

SEQ ID NO: 428 - protein, 1132 aa, unidentified; identical to SEQ ID NO: 423
  REGION 1..1132: note = Description of Unknown: uncultivated organism with predicted taxonomy: Rothia
  REGION 1..1132: note = MG3-8 effector

SEQ ID NO: 429 - protein, 1110 aa, unidentified
  REGION 1..1110: note = Description of Unknown: uncultivated organism with predicted taxonomy: Brevibacterium
  REGION 1..1110: note = MG3-42 effector
MNKDYAVGFDVGDRSVGVAFVEFDGDVPVKLLRAVAYRHDGGIDPTTNKTPQSRKATAGVARRVRRMRKERRRRLNELDKFLRQAGYPVEGDDRGETYEPWKARANCVTGFIEDEAQRKLELSRAIRHMARHRGWRNPWHTVSQELREHVPSSQHQKNVANAQEIFPGELDANATVGQLGAVAGKYNRLLRPRTNEKAKESGLIPVLSYKVLQCDQLDELQRMCKMQRLDEDFESELLELVFGQKRPVVRAENIGRDELPGMNGHPRAPRSSLEFQEFRIRDSIANLRVKSSRRDRKGVGLASEVVNNVVDYLLEWREPDDPTWAEVAELIGVDPDLLVAPVFDDVRRMIAPVDRTSRLLEKTLSKKAFKPVLEWWNNTSFEQKSMLVALISDPTDHHEDWAVSAGIADVIASWPDGLLEELNSLNFESGRSAYSLLSLKKMNDCMAIRGCNLHDARKEVFDVDDSWRPTPPKIHEPVGHPTVDRVLPIVRRTIMEAHRRWGVPRSIHIEHTRSSLLGPAARAEYQREVNANRRARERSLESLREQGVADPTVATVRRFSAVQHQNGVCLYCGSAITAKPGDSGCELDHVVPRSGGGSSKRENLVAACRRCNSEKGNLPFSLWAAESTRPEVSVEAALTRLQNFNWERRDRAVKKGLIRRLKQTSEDEPIDERSLESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGTNRGPLHKDTVRCADWKPIAEEWSEKEIERIVSPDVHAAVTEAIGLKGGKLSATSCSNVILQNGKFGEKVALAKSSAACIQVNGGVVEIGESIHHARLFAWRGRRGAIEMGMVRVFTAELPYILKNSTHGDVLTATIPASTFSFRNTPATLRKKLLAGEAVSVGWLTQNDEIEIEVDEFACGNTSFAKFLTEIPEKRWRVDGFYDNRRLRIRPAYLSAEGLTDNHSKVVHETLEKGQFVNAGALLSASRTLLIRRTALGAPRWKLDSSGLPVSFSPLKLAEEAL

SEQ ID NO: 430 - protein, 819 aa, unidentified
  REGION 1..819: note = Description of Unknown: uncultivated organism with predicted taxonomy: Brevibacterium mcbrellneri
  REGION 1..819: note = MG3-68 effector
MNKDYAVGFDVGDRSVGVAFVEFDGDVPVKLLRAIAYRHDGGIDPTTNKTPQSRKATSGVARRVRRMRKERRRRLNELDKFLRQEGYPVEGDDRGETYEPWNARANCVIGFIEDEAQRKLELSRAIRHMARHRGWRNPWHTVAQELREEVPSSQHQKNVANAQEIFPGELDANATVGQLGAVAGKYNRLLRPRTNEKAKESGIIPVLSYKVLQCDQLDELQRICRMQRVGEDFESELLELVFGQKRPVVRAENIGRDELPGMNGHPRAPRSSLEFQEFRIRDSIANLRVKSSRRDRKGVGLASEVVNDVVDYLLEWREPDDPTWAEVAELIGIDPDLLVAPVFDDVRRMSAPVDRTSRLLEKTLSKKAFKPVLEWWNNTSFEQKSMLVALISDPTDHHEDWAVSAGIADVIASWPDGLLEELNSLNFESGRSAYSLLSLKNMNECMATRGCNLHDARKEVFDVDDSWRPTPPKIHEPVGHPTVDRVLPIVRRTIMEAHRRWGVPRSIHIEHTRSSLLGPAARAEYQREVNANRRARERSIESLREQGVADPTVATVRRFSAVQHQNGVCLYCGSTITAKPGDSGCELDHVVPRSGGGSSKRENLVAACRRCNSEKGNLPFSIWAATCTRPEVSVEAALVRLENFNWEKRDRAVKKGLIRRLKQTSEDEPIDERSLESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 431 - protein, 1110 aa, unidentified; identical to SEQ ID NO: 429
  REGION 1..1110: note = Description of Unknown: uncultivated organism with predicted taxonomy: Brevibacterium mcbrellneri
  REGION 1..1110: note = MG3-88 effector

SEQ ID NO: 432 - protein, 1055 aa, unidentified
  REGION 1..1055: note = Description of Unknown: uncultivated organism with predicted taxonomy: Planctomycetes
  REGION 1..1055: note = MG4-5 effector
MGDQQTLQATSYCLGLDVGVQGVGWAVIDLDDQGQPLGVRRTGVRCFDSGVGSETEFEKGVDEPPSTKRRQARQQRRQLWRRAQRQRRVFRALQEAGLLPPGPPTPVSRDKILRTLDADLAIQFGSLEDRIAAHLLPYRLRALALDTPLPPYALGRAFYHLAQRRGFLSNKKALKEEKEAGEVKKGIAELQEEMNRAGARALGEYFSSLDPEQRRIRNRWTARQMYLDEFDRVWEAQSRYHPRLTDELKTKVRRAIFFQRPLKSQKGLIGRCELEPRHRRAPLASLLAQRFRYWQKINDLEVIQPDGVVRPLSPEERHKLAHFLETQAEATFARIRKLLDLKKPKGSQEDFAFNLERGGEKRILGNRTAAKMAAVLGQRWAAMDDEDKRRLVNEILSFEKEAPLARRLVRAWNLDEPTAAQLAALDFEPGYAALSARAIRKLLPLMQREGMRFATARKQVYGDHLLGTRAYDALPPVAKAIPSLRNPAVCRALTEVRKVVNALVRAYGKPAMVRIELARDMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHLNDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRKVSGQLHEESNYSKPHMTVDNKGNLVEHRHIRKPLKDMSVEEVEAIVDDRVRKLVQEKLRQLGQEPKKAFADEANHPYFTTADGRLVPIHKARIRKTVATITVGPPQCPRHVAPGLNHHIEILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 433 - protein, 1026 aa, unidentified
  REGION 1..1026: note = Description of Unknown: uncultivated organism
  REGION 1..1026: note = MG4-11 effector
LVGYEKSFFLGDLSKWQPVSAGMVAKGNLEGGPYLNYPGPLDRGPGRWTARAYSNVGRADHNQVLNKQNRKNLSMNKKNSYVLGLDLGTASIGWSIIPLDSAAIDADNINMGVVIVDEPVDKKKKTPLNVDRRNARQQRRMKDRKNRRKVHLFNCLQRAGLLPSTPCHTPFQRQDLLNELDSTHYGLDMSGNDLDLLLYRLRAMALDEKLELYAIGRILYQLAERRGFKSNRKDTTKDNEDGEVKKAIAGLGEEIDKAGSRTIGEHFAAYDTTQKKIRQTYTSRQWYEDEFDLIWAKQSSYYPDMLTDALRKEIRDIIYYQRPLKAPKRGMCDLEKGQVRVSKSDVAFQRFRYWQVLNNLEVADGHSSFRPLRAKEKAVLVQKLEVTKKVTYKAIKKLLGFSESAVFNYEAMTDTIPGNSTIASVYAVLKDKKTKPSLELCATIAEKILAFEDTGALVKNLVRKYHINRDVAEKLAGLEFEDGVAMHSKQAIERILNKMKHEGKSYATALKELYPDRNRADKVYDLLPPVDEWTKGSTKITNPSVHRILTQLRKLVNALVREYGKPALIRIELARDLKHNVKTKSKIIAQIKSREEEREAARKGLADLGIDNPTPANIKKWVIAERCNWTCVYTGKRADKRVEFGPHPQFDIDHIQPYSRSGNDSLGNKVLCFSAENRHVKKNQTPLECYGDDEERWNEIMGRVSAITGPDRVKTYRYFITTAEENEGFTARSLTDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQKIRGELHDAGIERYPGRKQKRKGEVYCIGTAERTKRYVHLNSNHHMEVVEGKDGRWEAVTVPRMEVYQRCRAKRPIVNRNHGDKWYVCSLAIGDYFTVDGGEKKLYVVKMLSGQVVGYMEHNDGRLQKTSGDDMSVFRTSINKLRQKGFRKVQLDVMGRLAVGKERCPTPQF

SEQ ID NO: 434 - protein, 1111 aa, unidentified
  REGION 1..1111: note = Description of Unknown: uncultivated organism
  REGION 1..1111: note = MG4-12 effector
MPNSNAPYVLGLDLGIASVGWAIRPINPSDITVDNLKMGARIFDLAVEDDIEKGKDKPKNATRRDARSARRRLWRRRRRKLKIFNLLVRYGLLPEGDYPTPDARQDMLSALDLQLVKEYFPNATHHDQQTFTYALRALALDRELSPHAFGRALYALAQRRGFKSNKKLDGREKEGEKETSQIKQDIAELEKNVAEHARTLAEYFTTVNPEEERIRARWVGRKSYEEEFEAIWTAQARFKPELLTDELKAKIEDAIFFQRPLKSQKGKIAKCELELDENGKRYLPVARKGEPCFQKFRVWEKIINLRVWDDAVDGRYGGGWRPLTHQEQDAAYELAEKSEKVTYKALRKELGFKSIKGVKKGEAVFETGYFNLEVAEDAMIGDRTSARIWKVLNETGDTLTQEEVDQAALYILDYESEDGLRRRLLKSFPTLSDAAATKLAYDVVLEEGYGAYSSVALNKLLAVMTKKRVNQALAKMEVYKAQYGEACDLLPPLEEAVGDIRNPTVTRTLAEMRKVVNAIIRRYGKPAQIYVELARDLKRSRKQRDEIFRKNQARKKERENIEKTLQNEFYIKSPKGRDVLKYRLWKECGGICPYTGMVISPDDLFGPNSRFDIEHIIPFSRSMDDSFANKTLCYAEENRNVKKNQTPIECYGDSPKFREILERVRKTFTGEFKFRKLKLFETQEPESITEFSKACLNDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSKVRGALHEETNLGAIAYPDPYTKKQRRKKRVFVTGLTSSKLLDSVVDPGVRRAIAEKLEEVGDAKKLADNPPRLPAHNRNFGVLIVKTAIWETNNPIRVGKGRSARFVKSGDNHHMEFYAVLDDKGNEIEWKFNIVSLYEAYERRRKHLPIVSRDFGPKTRFKFSLVKGDAIREKATGKIYFIAGLSTQGEGKGIYITGALNTCAKPVTVIKEEYSKMSKMKRGVAQGDMKGLPKEVAYFRSTNLVDLMKRFEKVRIDPLGNVERSNS

SEQ ID NO: 435 - protein, 1102 aa, unidentified
  REGION 1..1102: note = Description of Unknown: uncultivated organism
  REGION 1..1102: note = MG4-13 effector
MEQKESYILGLDLGANSIGWALLEAHPDPEEKGRLKAHGIKQIGVRIFEAGVEGEIEQGKDQSRAVDRRDARLARRRLDRISRRLSHLFYLLMSAGLLPEHPAYKTELGKKKSAKERKQERDLKAKARHEVINQLDQDLVKKWREKEPLAKETLPYILRAKALDEKLELYELGRALFHLAQRRGFLCNRKAKAKDDEELGKVNQGILELEGKIEGAGARTLGEYFSKLNPKEERIRSRWTSREMYLKEFEQIWNAQEKHYPKILTPEFKKKIWRCIFYQRPLKIQHHLIGECQYEKGKKRAPSACLAFQRFRMLQQLNNSYLISPDGEILNDGRLTKEQRERLIEVLEKKAELKFSKAKKILGLTKEYRFNFEKEDGKGEFLGNETAEKLIKVFGEERWSRFSEQEKNEIVQDLISIQHKSGLVKRGKNKWGLDDENAEEFSKINLEEGYCGLSRLALSKLIPLMETGLTYMEAVKQVYPDRLQNEAFDQLPMVINQMPELKNPVVKRVLTELRKIVNAIIRKYGKPEQIRIELAREMKKTRQQREEIWKKNKQNEEKRKQAAQAIIKEAGENPKPADIEKYLLWDECNGICPYTGKSISLKQLFSGEVDVEHIIPYSICLDNSYFNKTLCFHDENAKVKNNKTPWQAYGSDEKKWNEILERVKRFKGDAAKEKLKKFQIKDLEELDDFISSQLNDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKKVNGPLHQETFYSPPKEVQGKIICHVRKPLENLSAGDIEDIVDPVVKKKVQEKIKELGGGDPKKLFAGSSTLPPEKLPCMTAKDGRVIPIRKVRIKCVMTPFQVGDKGRERFVTSDTNHHLEIFETKDKKGNVRWDGAIVSQYEAMRRLRAGEPIVKREHGKGKEFKFSLALNECVKLLDEKGQEIVCVVKGISQLSAGPIVITLRHICDARPTSEYQKQIKMRKELKKNYDKKLAEEIEKMLPVFIFKGPDSLREAKGQKILITPLGEIRTAND

SEQ ID NO: 436 - protein, 1047 aa, unidentified
  REGION 1..1047: note = Description of Unknown: uncultivated organism
  REGION 1..1047: note = MG4-14 effector
MAQLPFSDYVLGLDIGANSLGWALVSLKDGIPQSILKVGVRVFEAGVEGDIESGKDQSRAAKRREARLHRRMLERRSRRLAKIAGLLQRAGLLPDGDLKSEESRIKVLRELDDSISARHHPTSEKPDPASAHLLPYRLRALALDQKLHPFELGRALYHLAHRRGFLSNRKAPAKDPNEEGKVNQGIHTLRQKIEESGARTLGEYFSRLDPEQERIRQRWTARDMLDQEFEAIWNAQAKHHPTILTHDFKKQLRRAIFHQRPLKIKKNLIADCELEKGQKVAPRCCLLFQRFRLLQQVNNLKVTEPTGKSRPLTRDERETLLHALETQDKLSFSEIKRLLKLRDHRFRMGEGDEEVLTGNKTAAKLREIFGDRWDELSPQERDRVVEDWWSIQKSETLRKHGVKYWRLDPEAAERLGKLALETGYCKLSKKAMRKLLPLMEEGISHAKAQEQLYGNEPPPKPFDKLPPLDRAPLPKPHNPAVHRALTEVRKVVNAIIRRYGRPSLIRVELARDLKKSKEDRKKISDQIARNRRDRERAKKALIDNGIQEPSRDDIEKWLLYEECNGICPYTGKSISLASLFGPNPQFDVEHIIPFSRCLDNSFTNKTLCDIEENRNRKRNQTPYEAYGADPARWEEIIQRVKRFRGKAAAAKLHRFQLESVDSLEEFASKQLNDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRKVSGALHEETIYSKPHTDKDGRVCHHIRKRLDKYFTRPMLDKIVDPVIRDIVRKHFQANGSDPKKAFSDPGNHPFLCAKDGRHIPIHSVRVREDRSTVQVGSGVSRRQVLTGSNHHVEIVEVEDEKGQPRWEGRIVTLIEAIKRLRNRQPIVQRDHGEGKKWVFSLAGGETIQLTDGGITKLYTVRTITVRRGQYVEIAYVPISDARTKTEIREKKEWRTDLLEPLRKLQCRKVLVTPLGEVRYARD

SEQ ID NO: 437 - protein, 943 aa, unidentified
  REGION 1..943: note = Description of Unknown: uncultivated organism with predicted taxonomy: Thermogutta terrifontis
  REGION 1..943: note = MG4-15 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDG

SEQ ID NO: 438 - protein, 1062 aa, unidentified
  REGION 1..1062: note = Description of Unknown: uncultivated organism with predicted taxonomy: Thermogutta terrifontis
  REGION 1..1062: note = MG4-16 effector
MKTKNGQVDYVLGIDLGVVSLGWAAIEIDNDGGQSLLGAGVRCWELSNASLEEVEKGKEEPPGQSRRQARRLRRQMFRRAQRLRRTYRVLQEMGLFLTGPRSSTARKAYLETLDQKAQEWLRTNVPDANDDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRASAQIRKVIDDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLVRFQAEEIPPDFALRQLSDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKRLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 439 - protein, 1060 aa, unidentified
  REGION 1..1060: note = Description of Unknown: uncultivated organism with predicted taxonomy: Thermogutta terrifontis
  REGION 1..1060: note = MG4-17 effector
MNTKNGQVDYVLGIDLGVVSLGWAAIQIEGNGGRSLLGAGVRCWDLSSGSLEKVEKGKEEPPGQLRRQARQLRRQMYRRAQRLRRTFRVLQDMGLFPAGSCSSMARKAYLEKLDRQAQQWLRQHVPNSDGGGLLAHTFIYRLRAVALDHPLPAELLGRVFFHLAQRRGFLSNRRDSQKEEERGVVKQAISQLRADIEKLGARTLGEFLSKLNPHEQRIRNRYTSRRMFQDEFEQIWNTQRRHHPNSLTDSNKARLYKALFFQRPLKSQRGLVGRCPLEVLTRNHSNGQVAYIHAFRRAPMACLEAQRIRYMQRINDLEFTDPQGGARLLSPDERQKLYDLAERNEDLSFTVIRKALGIPTGKKDQGWQCNLERGGEKKLPGNRTAARIRKIIGDVAWENLGSVKQKPLVDTLIALLSPDALTEHLRTVWGFDCKIASQLAELQLEQGYHSFSRRAIRRLLPLLEQGERLNAAIQKVYGGTRLRITQHLKLPPVRQVLPTTRNPLLVRALTELRKVVNAIIQKYGIPQFIRVELARELKRSRKERAEISKRMREQQKRREEAAQKVLEELGRTATPRDIEKYLLAQECNWQCPYTGRQITVQSLLGDDPQFDVEHIWPLHRSLDDSFMNKTLCYHHENRSVKAGRTPYEAYATDPLRWQEILSRVRSFRGPFARQKLDRFQAVEIPPDFAMRQLNDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRRLSGALHDQTHYSPPVEEGKTKVRKRLNALSAHEVERIVDPEVRRLVQEKLKQLKMSDPKKAFATDVNLPIIHGKNHTALPVKSVRIWVNSLVIPVGDGPRRRYVVRGNNHHIEIYAVLDGQGYEIEWKGKIVSLYEAYERKKRGEPVVCRDHGPNTRFKFSLAKSEYIEWIRIDGQKELVRVVAISDNKLEFRLPYDARPSTLIREAHERIFATYRQLFERRARKVLVTPLGEVLPAND

SEQ ID NO: 440 - protein, 1062 aa, unidentified
  REGION 1..1062: note = Description of Unknown: uncultivated organism with predicted taxonomy: Thermogutta terrifontis
  REGION 1..1062: note = MG4-18 effector
MKTKNGQVDYVLGIDLGVVSLGWAAIEIDNDGGQSLLGAGVRCWELSNASLEEVEKGKEEPPGQSRRQARQLRRQMFRRAQRLRRTYRVLQEMGLFLTGPRSSTARKAYLETLDQKAQEWLRTNVPGANNDGLLAHTFIYRLRAAALDHPLPPELLGRVFFHLAQRRGFLSNRRTLEKNKDEELGVVKQGISQLQDEIQKSGARTLGEFFSRLNPHEQRIRNRYTSRKMFQDEFEQIWNAQRSHHPNSLTDSKKARLYKAIFFQRPLKLQHGLVGRCPLEVLPRKRPNGQVEYIYPFRRAPMASLEAQRIRYMQRINDLEFTDPQGQRRVLSPEERQKLYDLAERNEDLSFTLIKKTLGIPTGKKGEGWECNLERGGEKKLPGNRTSAQIRKVIGDATWEDLGRERQKALVDTLIAFLRADTLEEHLHRVWGFNREVASQLAGLPLEQGYHSFSRRAIRRLLPLLEQGERLNAAIQKVYGGTQRKINQHAELPPVRQVLPTVRNPLLIRALTELRKVVNAIIRKYGIPRCIRVEVARELKRSRKEREEISKRMREQQKRREEAAQRVLQELGRTAAPRDIEKYLLAEECNWICPYTGKQITTQALLGDHPEFDVEHIWPLHRSLDDSFMNKTLCYHQENRSVKAGRTPYEAYATDPVRWQEIITRVRNFRGPFARQKLDRFQAEEIPPDFALRQLSDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRRLSGALHDQTYYAPPTEQGKTKVRKPLREMSSHEVERIVDPTVRDLVKEKLKQLGTSDPKKAFATDANLPIIRGKNNTALPVKSARIWVSSSVIAVGDGPRQRYVVPGNNHHIEIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 441 - protein, 1081 aa, unidentified
  REGION 1..1081: note = Description of Unknown: uncultivated organism
  REGION 1..1081: note = MG4-19 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 442 - protein, 1081 aa, unidentified; identical to SEQ ID NO: 441
  REGION 1..1081: note = Description of Unknown: uncultivated organism
  REGION 1..1081: note = MG4-20 effector

SEQ ID NO: 443 - protein, 1081 aa, unidentified; identical to SEQ ID NO: 441
  REGION 1..1081: note = Description of Unknown: uncultivated organism
  REGION 1..1081: note = MG4-21 effector

SEQ ID NO: 444 - protein, 895 aa, unidentified
  REGION 1..895: note = Description of Unknown: uncultivated organism with predicted taxonomy: Planctomyces sp. SH-PL14
  REGION 1..895: note = MG4-22 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIELARDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHRLTGALHDETNYGRPHKEGGKDVVHIRKQVVGMSAGDIENIVDPTVRESVREKAASFGGDLKKWTPK

SEQ ID NO: 445 - protein, 1081 aa, unidentified
  REGION 1..1081: note = Description of Unknown: uncultivated organism
  REGION 1..1081: note = MG4-23 effector
MGETNTQTGSYILGIDLGSASLGWAAISLDGAGMATGLLRSGVRLFNPAVTGDIEKGQDESNAVARRTARLIRRQLRRRAARQSELFQLLQRYTLLPPYKGAEADASQQRHSILNALDQELTAKWVKPGNAGAQAAIELPLYLLRKTALDAALEPFELGRVFYHLSQRRGYRSNRKDQASDKGTPGKAKKADDLGAVQGGIKELEDAIRSSGTRTLGEYFTSLDPHSQKVRGRWTARRMYEEEFAAIWAKQVTFHPALLTEELHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIKLARDKKNPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 446 - protein, 1081 aa, unidentified; identical to SEQ ID NO: 441
  REGION 1..1081: note = Description of Unknown: uncultivated organism
  REGION 1..1081: note = MG4-24 effector

SEQ ID NO: 447 - protein, 1081 aa, unidentified; identical to SEQ ID NO: 441
  REGION 1..1081: note = Description of Unknown: uncultivated organism
  REGION 1..1081: note = MG4-25 effector

SEQ ID NO: 448 - protein, 1081 aa, unidentified; identical to SEQ ID NO: 441
  REGION 1..1081: note = Description of Unknown: uncultivated organism
  REGION 1..1081: note = MG4-26 effector

SEQ ID NO: 449 - protein, 1081 aa, unidentified; identical to SEQ ID NO: 441
  REGION 1..1081: note = Description of Unknown: uncultivated organism
  REGION 1..1081: note = MG4-27 effector

SEQ ID NO: 450 - protein, 1081 aa, unidentified; identical to SEQ ID NO: 441
  REGION 1..1081: note = Description of Unknown: uncultivated organism
  REGION 1..1081: note = MG4-28 effector

SEQ ID NO: 451 - protein, 1081 aa, unidentified; identical to SEQ ID NO: 441
  REGION 1..1081: note = Description of Unknown: uncultivated organism
  REGION 1..1081: note = MG4-29 effector

SEQ ID NO: 452 - protein, 770 aa, unidentified
  REGION 1..770: note = Description of Unknown: uncultivated organism with predicted taxonomy: Alphaproteobacteria bacterium
  REGION 1..770: note = MG4-30 effector
LNLERDYVFSIERGGEKTLKGNPTNADFRKALGERWDKMTPEERDRAVEYVHAFQRPDKIKVAAMKKWGLDEQSAEELAKISLEPDYLNLSRVAIEKLMPLLEGGFPYGALAPRYSAIGAEAVQKLLASAEAGTPFKETCETILGEPTVSSQEHDLLPPVGQALSEIRNPAVMRSLTELRKVVNGVLRHFGKPAQIRIELARELKKSKKQREAESKRNRENEAVRVKAKQTIKEITGDEHPSTDDVRRVQLFNDCRGTCVYCGETIAARNFLGRESQVDIDHIIPFSRSMDNSYANLVICHARCNRNKGDRTPFEAFSVDPESYGQIRDRVKIFAGDGRTVSEKIKRFEMDEGELEKFLGDFRNRQLNDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKKVSGALHEETIYSRPFPVGAGFKPAPTKAKPRCTDAEATEVRVRRGLSPSAKSTKQISAPEVEDIADPAVRKLVVAKLAELGGDLKKFADEKNLPFFETKDGRRIPIKRVRVSKALPTFTLGHGRSARHVASESNHHVEIYAELDQNGTEGEWDGEVISMYEAYQRLKAGRPVVQRDHGPLARFKFSLAPGEVVECDDKNGARSLFVMRKASQISSGQLQIGFAPPNDARKAREIQTSRAWLWANPNTLGDRNSRKVVVNPLGEVSESHE

SEQ ID NO: 453 - protein, 866 aa, unidentified
  REGION 1..866: note = Description of Unknown: uncultivated organism
  REGION 1..866: note = MG4-31 effector
DKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRKLRGKLHQDTLYSEEIHGTRRIRRELHSLKPNEVEKIIDPRIRSVVSKKLAELKESNPAKAFADPTNLPTLTDHNGRTTRLRKARVRVSAKPTKIGKGASERSVNLGSNYHTVISQDERGRWCETTVSLIEAMRRKEDGEPVIQTPEGHTFLYSLVKNDHVEIPNGNGMGRIMRVESISQGFVEFGEHNDARTQAERGSERFYLRSGKKWTEVRPRKVAVTHLGEVKHAGG

SEQ ID NO: 454 - protein, 1036 aa, unidentified
  REGION 1..1036: note = Description of Unknown: uncultivated organism
  REGION 1..1036: note = MG4-32 effector
MASEFILGLDVGVASIGWAIIDWDGAPCGIRLAGTHLFEAGVDPGKSDPETAMLLGREQSRAKPRRDARAMRRQTWRRARRKKKVLGALIRADLLPPGDIRTPAAIDAYMKSLDASLRDRWESKGASHRDRQLLPYRLRAAAVTREVERHELGRGLYHLAQRRGFLSNRKAPDRADEDRSEMKKAIGDLATQIAAHDPPTLGAYLASLDPDDARLRGRWTSRQMYLDEFDRIWDTQAERIGLTQAQREEIHNAIFHQRPLKDQSHLVGRCSLVDGAKRCPIGERIAQRFRVLQQVNHLRVVLDDRTERPLTPGERQAMLDALLTKGDLKVAAARRAAGLPRSATLSIERGGEKRLVGHRTDAKLRKVFGDERWASMSEEEKDAAVHDLRSVRLPATLRRIGLTRWGLDTESAEEFAGLSLEEGHAAHSREALRRLVPRMEQDGLSYSEARKDEFPGSFESDEPHDLLPALDQWDRDLRNPSVARALTELRKLVNAIVRRYGKPVRIHIELARDLKSGRGRRERIANRMRDREKEREAAASAIAREIGVADPPRWMIEKHLLAEECGWRCPYTGKGFGIHDLLGRNSQFDLEHIWPFSRSLDNSYANKTICYHEENRNRKQGRTPAEAYSEEELQAILERVRAFKGDPFLIQAKLRRFTDPIEEGFTERHLQETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRKVRGPLHKETLYSKEHNGRRRVRKRVETLSKTDVEKGRIVDERALAAIRAKLDELGEPNPAKAFKDPANLPTVRGHDGRSVTLRKVRVEVGVQPRAFGKGAKRRYAQTARNHHMAFYKRSLPGGRMERTTKLVALADMVDRSSVVDREADDGFEFAFSLAPNEFVVIKDDQGDDRLCRVLSISADDLELVEHTDGRTSTDRKGERIRFRRRALSEDPIRKVHVNYLGEVHDAGG

SEQ ID NO: 455 - protein, 787 aa, unidentified
  REGION 1..787: note = Description of Unknown: uncultivated organism with predicted taxonomy: Insolitispirillum peregrinum
  REGION 1..787: note = MG4-33 effector
MLDYTLGLDLGAASVGWAVVKEPTTDQDTDSVLHLGVHRFEAGVADPGKMGHGGEESSAKPRRDARQMRRQLWRRKRRRRLLLARLQEHGLLPAGELDTPEAIHVYLRELDQAILDRNYPSATHEQQLKLPYLLRAKAVSERIEIDELGRVLYHLAHRRGFLSNRKTDKEDDKNETEFKQDMAELSQLVKQHDPPYLGAYLACLNPDEQRLRGKRTSRQMYLDEFDAIWDEQSKHHGDLLTAEVQKTLHNTIFYQRPLKSQRHLRGKCSLTGKTRAPIALRIVQRFRAIQKLNDLQIVFADGTKRKLDEQERAKVFELQMTKGDVTFHSLKAKKVLGLPKDATFNLAEIDKKLIGHRTDAKLRKALGDRFDGLSEDQRDAIVQDIRSYRDTGPLAKRLKATYDLPSDIAADLSKVKLEKDRAAHATEAIRALLPLMERGIQYATARKQVYPESFASNTKTYDLLPSVNDWLKQHEKAVAIRNPAVMRGLTELRKVVNAIIRRYGKPKCIRIELARDLKNSRKKRADISKQNMERRGQREKAAELLAKQFGIEQPSHHDREKVLLHWECGGFCPYTGKPIELNDLFGPNPSFQVEHIWPLSASMDDSFMNKTLCHVDENARKGGRSPVDCYDQKTLDLIKERIGRFNCDWKVREAKRRRFTEPIPEDFHQRHLNDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 456 - protein, 1066 aa, unidentified
  REGION 1..1066: note = Description of Unknown: uncultivated organism with predicted taxonomy: Planctomycetes bacterium
  REGION 1..1066: note = MG4-34 effector
MIAERRREREFILGLDLGVASIGWALLEVDESMRPTGVIRAGAHLFEAGVEGAIEQGRDESRAAPRRGARAMRKGHWRRQRRRRQVLLALQRHGLLPPGDVSTPSAVDRYIKSVDERLRETWCSNGDHRAQLVFPLQLRAAAATQDLGPHDIGRAIYHLAQRRGFLSNRRTEAVRGDEEDEGKVKSAIKDLAQAIDHSEQPTLGAYLATLDPDTERIRGRWTGRQMLLDEFETIWSRQAPKHEAMTDTAYEEIRHAIFHQRPLRKQQHLIGRCSLIPDKRRAPVAHRLYQRFRLLQKLNDLEILEPGRLQRPISAQERAIALALLEKNESVRFTTLRKKKGGLGLPKGTTFNFETDGESSLIGHRTDAKLRDVFGDDYDALSEREKDQIVEDLRSIREPAALKQRGVQRWGLAEEQAIRFASVRLEEGYGSHSLAAIRRLLPHMEEGARYAAARLAEFPESFTAVEPVDALAPVESALGKIRNPAVERALTELRKVVNAIIAEHGKPQLIRIELGRDLKRGRKEREKQSKRMAARRKQREEAKRRLLKETGIADPRRSDIERVLLADECNWICPFTGVKFGWSDLFGPTPRFDVEHIWPYSRSLDDSFLNKTICDQRENRTRKRNQTPHEAYGATPEVYERILQRVRAFSGDPWVLAAKLSRFEAESIPEGHVDRHLNDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRKLSGALHAETNYSRPIHPAGAHHVRKELHKLTASDVDRIIDPRIRELVRQKLETIGEPNPKKAFAAPEHLPTITGSDGRTRTVRKARVRTGVKAKPIGKGVNRRYVAPTQGSNHHTVIVAHLNDAGEEVRWTDHPVTLLEAQQRKSNGEPVVQRDWGPGKRFKFSFASNEFIEMDADDGVRRIYRVLSLSEGNYELSEHIDGRKKTDRIQDQKRVKTEWERSKKVGTLIRERIVESAESMRRRKAGKISVSHLGEVRRAGG

SEQ ID NO: 457 - protein, 1036 aa, unidentified; identical to SEQ ID NO: 454
  REGION 1..1036: note = Description of Unknown: uncultivated organism
  REGION 1..1036: note = MG4-35 effector

SEQ ID NO: 458 - protein, 1053 aa, unidentified
  REGION 1..1053: note = Description of Unknown: uncultivated organism with predicted taxonomy: Proteobacteria
  REGION 1..1053: note = MG4-36 effector
MTYVLGLDIGARSVGWALLEKEGDTFTRIVRAGVRVFEAGTEGDIERGRDESRGATRRLKRLARRQIRRRRQRARALYRELANAGLLPAIKPSPGSPMALLIQDEINRLDHELRERYAGERAVSQLPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRFRLLQTVNHLRVTENRSSPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVPVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVEENGRRVWRGDVVSMREAIERATRGEPVTRRRGGAGVRYLFSVSKEDTLRLHGKYEGLWVVKKIAQKGQITLVSQFDARSEQNRTVFSPRVGGLQGYSAEKVVVLPIGDVVPCNE

SEQ ID NO: 459 - protein, 754 aa, unidentified
  REGION 1..754: note = Description of Unknown: uncultivated organism with predicted taxonomy: Solemya velesiana gill symbiont
  REGION 1..754: note = MG4-37 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDD

SEQ ID NO: 460 - protein, 1032 aa, unidentified
  REGION 1..1032: note = Description of Unknown: uncultivated organism with predicted taxonomy: Acidobacteria
  REGION 1..1032: note = MG4-38 effector
VDYVLGLDLGARSVGWALIELQGDEPKRVVAAGVRVFEAGAEGNIEEGREESRGVKRRQARLARRQTRRRRQRLRQLYRELAGAGLLPAVQASPGRPFAVAVQEAINVLDGQCRLQYQHDPCANRIPYLLRARALDEPLAPWELGRVFYHIGQRRGFKSNRKAEARDPEERSLVYDGIRRLEEEIQRTGARTLGEYLSKLDPRQERIRCRYTQRSMYEREFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 461 - protein, 784 aa, unidentified
  REGION 1..784: note = Description of Unknown: uncultivated organism with predicted taxonomy: Planctomycetes
  REGION 1..784: note = MG4-39 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEVAGARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDVEHIIPYSRCLDNSFANKTLCEVAENRAAKKNRTPYEAYGNAPQRWHEILQRVSRFRGDAAKAKLRRFQLTEIPADFANRHLNDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 462 - protein, 1106 aa, unidentified
  REGION 1..1106: note = Description of Unknown: uncultivated organism with predicted taxonomy: Thermogutta terrifontis
  REGION 1..1106: note = MG4-40 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSAGDQKDGEDRKNKKNKKGKKSEKSERERIRAAISQLQQAMQTSGARTLGEYFARLDPHQERIRGRWTSRRMYKEEFEAIWTAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLRALSEHDPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 463 - protein, 811 aa, unidentified
  REGION 1..811: note = Description of Unknown: uncultivated organism with predicted taxonomy: Planctomycetes
  REGION 1..811: note = MG4-41 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDRPLPVYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 464 - protein, 1111 aa, unidentified
  REGION 1..1111: note = Description of Unknown: uncultivated organism with predicted taxonomy: Thermogutta terrifontis
  REGION 1..1111: note = MG4-42 effector
VDHLEVHVSDSAGGHVSEIPEYLLGIDLGVLSLGWAAVKLQDGRPIGLLDAGVRAWDLQNIAESDIAVGKEEPPSQTRRQMRQMRRQLFRRAQRLRRTWRALQQLGLFPPGSRHCAARKAFLDQLDGQAKAWLCQHRFGSADPPPHWEDTWIYHLRAAALDQPLPPELLGRVFFHLAQRRGFQSTAKTRSGGEQKDGEDRKNKKNKKGKKSEKSERERIRAAISQLQQAMQTSGARTLGEYFARLDPHQERIRGRWTSRRIYKEEFEAIWAAQAPFHPEWTAADKDRLFRALFFQRPLKSQRGLVGLCPLESKVLPPAQPGQKAKVLYRHRRAPLASLEAQRIRYMQRINDLEIIAPDGTHWVLRDPAYQLMRSKLYDLAEHHEELTFPAIRKALGIPTGKKGEDWKFNLEAGGEKKLPGNTTAARIRRILGDQRWDSLGPDGQKQLVDTLLAFLSEEALQQHLEAHWHLDPPTAQALAHLELEPGYHSYSRRAIRKLLPLLEQGLRLNEARRKLYPQKEADAGGWDRLPPVCQVLPQVRNPLLVRALTELRKVVNALLHKYGKPVQIRIELARDIKRSRREREALSRRMRKQEDSRKKAAQIAREHLGREPSPFEITKVLLAEECNWKCPYTGREKIELAALLGPEPQFDVEHIWPFDRSLDDSFANKTLCYHEENRLRKSNRTPWEAYGSDPHRWGEIIARVKQFKGEWAKEKLRRFLAQELPEDFPQRHLSDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRRLSGPLHDQTFYAPPVPSPEDPKKLRTKVRKKLSELSDNAVEDIVDPEVRRLVQEKLQALSQHDPKLADPKKAFASPENLPYLRSRRTGQIIPIKSVRIWVTAHLEKIGSGMRQRYVIPGTNHHLEIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 465 - protein, 1111 aa, unidentified; identical to SEQ ID NO: 464
  REGION 1..1111: note = Description of Unknown: uncultivated organism
  REGION 1..1111: note = MG4-43 effector

SEQ ID NO: 466 - protein, 1056 aa, unidentified
  REGION 1..1056: note = Description of Unknown: uncultivated organism with predicted taxonomy: Proteobacteria
  REGION 1..1056: note = MG4-44 effector
MSGENIETILGLDLGANSVGWALIECVDGKARRILGMGSRIFEAAIEGDLEKGQEEPRAVERRMARQMRRQHKRRVMRMIRVGELLQQAGWFPPGNLRDSVERDRILKELDKSLRQQYADRGFHLSGIDAIRGIAYFLRARALDEPLEPYALGRAIYHLAMRRGFLSNRKAPMKKDEELGAVKKGISDLESEMKQCQARTLGEYFYKVDPVHEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQEKAQLISELNSDITEERLRYRAEKVWGITDPERVDKLVKLTLPKGYCSLSKIALKKLVPLMREGKDYVTAAREVYGDLQYKNQTFDRLPPFLKVDRTLRSPVVIRTLSETRKVVNEILRVFGRPNRIHIELAREMKQSRIQRQKRYQTMRDREKMRNQARQSLQAELGWDPNDIKGRDIEKWLLAEECSWVCPYSGKPINYHNLFGEKAEFDIEHIIPYSKSLDDSFVNKTLCHREWNQKKGNRTPAQAFKNTPEWEAMLQRVRAFKPLHAVHMKKGESSKRNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLADHDGDPKKAFNDPDNHPKINDIPIHAVRVRDYVKPEKIGKDFCPRYALTDSNHHMEIIEEKDKKGNPRWTAIVVSRFEAMQRKIRGEPIVQREHGEGRRFVCSIASGDTFSYREKEDGPGIFARVRSIWKQNVEFVQINDARLKAEIKKENEWYVRSVNELRKMGFQKVSVSPIGEVYPAND

SEQ ID NO: 467 - protein, 1056 aa, unidentified; identical to SEQ ID NO: 466
  REGION 1..1056: note = Description of Unknown: uncultivated organism
  REGION 1..1056: note = MG4-45 effector

SEQ ID NO: 468 - protein, 1111 aa, unidentified; identical to SEQ ID NO: 464
  REGION 1..1111: note = Description of Unknown: uncultivated organism
  REGION 1..1111: note = MG4-46 effector

SEQ ID NO: 469 - protein, 1056 aa, unidentified
  REGION 1..1056: note = Description of Unknown: uncultivated organism with predicted taxonomy: Proteobacteria
  REGION 1..1056: note = MG4-47 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPDEKRAPVWSLDYQRYRVLQTVNHLRVAENRSAPRPLTHEERWRLLEELEKKPKVTIAQAKKLLGLKKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVTVHPLLPPVADSGVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHRVTGALHKESHYGYSKVSESDNPVFKIRKPVYELTKSMVQKIVDPAVRSAVQEKLAAVGGKVEALKGNWPVLQSKNGQSRPIKKVRIQVALSPIEVGKNHRKRFVEVEDTHHMEVFEVPGRLSKWKARVVKMHEAAARLVCGANIFDRHLDSKSRYLFSLMKGDCLQMHGEMSGIWIIKTIRANTQIELVSQYDARPVGSSKGGARVTRKCISEFQKFSPRKVVVLPIGDVVRCNE

SEQ ID NO: 470 - protein, 1026 aa, unidentified
  REGION 1..1026: note = Description of Unknown: uncultivated organism
  REGION 1..1026: note = MG4-48 effector
VRQDEHGTVHIVDSGVRVFPWTIEEDTLKSRNIERRTARHRRRQLERRARRRRVLARLLHHYGFLPPWPADWRTFDFHRDPAWGPLLAKDPYELRAKALDQLLEPWEFGQVIYHLAHRRGFAGFRKVRDDEELGNIRREIEQLDQEIKRSGARTLGEYLAQLDPRERRRRGRHTSRDWYRAEFELIVATQQRLGLPLTPDMVRTLRRAIFHPRPLKVVPSAIGRCPLVRGRRRAPQGLREAQEFRYLQNLANLRIILPNGVQRGLTPPERKTVIQHLEQVEEMTFNELRKLLFADRVESARSRSQTAPERSHTPAAVTADGRTPAAMPVDTTVPSTMEQWNPGWKLQDIRFNLEEGEREEIEGNVTAARIRKAIGAKWDPATPDIRRAMVEMWIGIEDEDVCKQVALRQTEWGLTESEAEALSQVAFEGGRCRFSSTALRRLLPHLRQGRSLYDAIQQEFPEHGEQVALDEVPPLGEEIPNPLVRRALSETRRIVNAILTTYGKPSEIHIELARDLRRPLCEVREMIKQMRKREKMRREAERKLCEEHGIRKPTAREIEKYLLWKECNARCPYTNQDIRAEALFGSHPRFDVEHIIPWSRCLDDSFANKTLCEAKHNREQKRNRMPTEAYSREALEQIWERVRRFQGDYAAEKLRRFQMDPPPELHLIHRGDQLHATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERKVQGPLHEETFYGLIRSPETGEIRPVVRKRIDTLTLNEVKNIVDPNIRQIVLERCGEKDPKTVFKDPQQIPWLDFGSKRVRLRRVRIYVNQEPIEIGQNPPRRCFTGSNHHLEIFDCRGQWRCEVVSRWEAMRRLRAGEPVVRRQDAHGCPLVFSLARGDTVELKWKSGTLIAVVQKFSERDYTFRAHDDGRMDKEIREDRIRIRSDRRLQEVLVRKLSVDVLGRAYVSRE

SEQ ID NO: 471 - protein, 1088 aa, unidentified
  REGION 1..1088: note = Description of Unknown: uncultivated organism
  REGION 1..1088: note = MG4-49 effector
VLQPMRVPYVLGLDIGVQSVGWALAQLDEEGNPCGILRLGVRSFESSSGSEQEIEKGTDEPASRQRREKRLMRRQLFRRQQRLRRTARVLQQAGLLPQFSLEPASRDAAITQLDAQLRSQFIGSGNHVDAQLLPYRIRAAALDEVLPAYALGRAFYHLAQRRGFLSNKKASAKKDDEDKGKVKAGIAELTRQIEAADARTLGEFFARLDPHQQRIRSRWTSRKMYQQEFDAIWEAQAPHHPQTLTAELKARLYRAIFFQRPLKSQKGLIGRCSLEKGRRRAPLACLEAQRLRYWQKLNDLRLKDARRILNAIPEAERLIDWLPQEGQGRLTLYAKQLLAQEFETNEELTFNRIRQILGLKKKKDSDLDFTFNLEEGDEKKLPGNRTAAKLLKALGQRWQDMPEDQRQRLVDEILSFEKEEPLARRLEKAWGFSPSEAANVAAIDFEQGYHSFSRQAIRKILPHLQQGQALATIIKQLYKDTQPQATVWDRLPPLRDVFPQVNNPVVRRALTEVRKVVNAILRVYGKPQRVHIELARDLKKSRHERQQLSKGMRQQQKQREDARNWLQHEMGISNPTAHDILKYRLWIECEKLCPYTGKPISKEALFGSEPQFDMEHIIPHSRCLDDSFANKTLCELAENRAAKKNRTPYEAYGHDPQRWHEILQRVSRFQGDAAKAKLRRFQLTEIPADFANRHLNDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRRLKGPLHEETIYGKPKQCVDEKGKTIQVAHVRKPLESLSPNNVDHIVDPVIRELVKKKLQELGTTDPKKAFQAKDNHPYMKARDGRIIPIHKVRIRVPTETLMAIGHGPTLRHVKPGVNHHMEIVATLDAAGNEIRWEGITVSLFEALQRLRNKQPVVQRDHGPGKRFKFSLSGGEYLEFVENGRNKLVRVSVISGDDVEFRLHNDARPNTMLRGVKGARAGLVRSADALRKLKARKVLVDPLGNILPAND

SEQ ID NO: 472 - protein, 770 aa, unidentified
  REGION 1..770: note = Description of Unknown: uncultivated organism with predicted taxonomy: Solemya velesiana gill symbiont
  REGION 1..770: note = MG4-51 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRDLKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGETNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETGISRDDVRKAMLWEECNGMCPYSGRSLGGFASLFSGNSPAQIEHIIPFSRSLDNSFVNLTLAHVSENAYKGDKTPWEAYGSNPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 473 - protein, 1053 aa, unidentified
  REGION 1..1053: note = Description of Unknown: uncultivated organism
  REGION 1..1053: note = MG4-52 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQCPLRDTEDLVGECAWIPGEKRAPVWSLDYQRYRVLQTVNHLRVAENRSAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDHPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQWVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVDEKGKKVWRGDVVSMREATERAARGTPITHRRGGVNTRYLFSVSKEDTLRLHGEHEGLWVVKKIAQKGQITLVSQYDARPEQGRTVFSPRLGGLQVHSAEKVVVLPIGDVVRCNE

SEQ ID NO: 474 - protein, 1055 aa, unidentified
  REGION 1..1055: note = Description of Unknown: uncultivated organism
  REGION 1..1055: note = MG4-53 effector
MSSYILGLDVGANSIGWAVVPLQNGAPAGVTRAGVRVFAAAVANLEEAQPETANAQRRLARLTRRRLDRLARRLEHLFRLLQRHGLLPPDPAPSPPASRLEAAHRRHDLLRRLDADLLSEWAARGARGEVPLPDPATLPHVLPYLLRARALDEKLSPYALGRALYHLGQRRGFLSNRRAGAKEEEGEVKKGIDSLAAEMAAAGARTLGEYFSRLDPQSARIRGRYTSRRMHEDEFALIWAAQCVHYPDRLTDDLKKQVHHAIFYQRPLRFRKDAIGPCQFELNRRRAPMALLACQRFRLLQSVNHLQVLLPDGRPRPLAESERQALIAALEEQGDLKFAQVRKLLALPRDTAFNLERGGEKKLPGNRTAAALRAVFGAARWAQLTPADRDRLVDDLRSIQQDEALVRRAMRVWGLDAAAAQQLAAVRLEQGYLNLSRQAVAKLLPLLEAGKPYATAVAEVYGPRPAPPPVDQLPLVSAALPHLTNPVVQRALTEVRRVVNALIRQYGKPECIRVELAREVKKNARQRHQIALRNRENERLRRAAAERIVREVGIANPSRADIEKVLLAEECNWHCPYTGKPISMAALFGEHPQFDVEHIIPFARSLDDSFMNKTLCDAEENRRVKRGRTPFEAYGSQPERWAEILRRVRAFKGSAADAKLERFRCESPPDATELCSRLLNDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRKVSGPLHAESFYSRPHRDPQGRECRHIRKPVEALSPDEVAAIVDDKVRECVRAALRAKNLDPDAIRNSRAIAQAFASPADHPCLVARDGRRIPIHRVRIRKVVNAFTLGDRHVVTETNHHVEIFARLNPDGEVARWEGKVVTLLEAVQRLRAGLPIVNRDHGPDTRFLFSLALREAVRMDDGQGGRMLCVVVVVSQTQQGRIDLEFRRHHDARPGMQGERIRKTPNSLRLAHAEKVVVDPLGRVWPAHD

SEQ ID NO: 475 - protein, 813 aa, unidentified
  REGION 1..813: note = Description of Unknown: uncultivated organism
  REGION 1..813: note = MG4-54 effector
EFDAIWAAQSPHHPCLTTELRERLAAVLFSQRPLKDGAELVGSCSWDPSQKRAPAWSLEYQRFRVLQEVAHLRYADESQVWQPLDAEQRSKLVAALSTTRELDFRAIRKLLGFAGKVRFSVEAGGEKKLRGNVVAAEFIRAIGEEWNALGAERQAELVRQVALAEDDDKLREELITNWRLTPEQAGRLVADVRLPRGYAALSLKAIRAALPYLEQGMSVQQAREAAGYELMPPVPARDLLPPLASSGIEVFNPAVKRSLTELRKVVNAVVRKYGKPAEIHIEVARELRKSREERQKESRRMREREAERERMRQKIHKEVGIPLEQIREEDVRKGLLYEECCRTCPYTGKPLGGFAGLFSGTSPVQIEHIIPYSISLDDSFANLTLCLASENAVKHNRTPYQAYSADPGRWEDIQARVRAFRGPYAAEKLRRFLMDEQAAAALLQRFSARHLNDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHRVSGPLHKETFYAVSGAPAAPTGTIRTRKPVFRLTEEDVDRIADPAVRCLVKQKLAGVGEARKLEKDWPVLPNAHGQPVPIKRVRLELRDAVRAVGQGHRRRWAEVGESHHVAVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 476 - protein, 950 aa, unidentified
  REGION 1..950: note = Description of Unknown: uncultivated organism with predicted taxonomy: Flavobacterium hercynium
  REGION 1..950: note = MG4-55 effector
LKELDKSLRQQYADRGFHLSGIDAIRGIAYFLRARALDEPLEPYALGRAIYHLAMRRGFLSNRKAPMKKDEELGAVKQGISELEREMKQCQARTLGEYFYKVDPVYEKRIRKRWTARQMYKDEFDTILQQQVKLGAIRDDPKFFRKLRKAIFRQRPLKSQCGLIGPCQFEKNEKRAPWHNLLAQEFRLLQKINDLRLIDPSTREERPLNAEERKILYDWLMEHGEATFAELRKKLGFNPRDGQKFNLEAGDETRLKGNEVAARLIAVLGEERWRGITDQKKAQLISELNSDITEERLRYRAKKVWGITDPERVDKLVKLTLPKGYCSLSKKALKKLVPLMREGKDYVTAAREVYGDLQYKNQTFDRLPPFLKVDRTLRSPVVIRTLSETRKVVNEILRVFGRPDRIHIELAREMKQSRIQRQKRYQTMRDREKMRNQARQSLQAELGWDPNDIKGRDIEKWLLAEECGWVCPYSGKPINYHNLFGEKAEFDIEHIIPYSKSLDDSFVNKTLCHREWNQKKGNRTPAQAFKNTPEWETMLQRVRAFKPLHAVHMKKGESSKHNPKYDLFCMEEIPPDYVDNKLNDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHRLQGRLHNDTLYSPPRVDENGKTYHVVRKPLDGNFKKVGDIEDPEVRRIVQEHLAAHDGDPKKAFNDPDKHPKINDIPIHAVRVRDYVKPEKIGKDFCPRYALTDSNHHMEIIEEKDKKGNPRWTAVVVSRFEAMQRKIRGEPIIQRNHGEGKIFVCSIATGDMALVDLEPTNPNVLVRVRGISFNEVSLVRANDARQKKEIVSSGDFIRKTPLMLQKMNFRKVSVSPIGEVYPAND

SEQ ID NO: 477 - protein, 878 aa, unidentified
  REGION 1..878: note = Description of Unknown: uncultivated organism with predicted taxonomy: Pseudoxanthobacter soli
  REGION 1..878: note = MG4-56 effector
SGAGLLPPITPVPGSPMAVLIQEAINRLDCELRRKYAGERAVSQMPYLLRARALDHRLEPYELGRAVYHLGQRRGFRSNRKAESGKKATEDPSKAKEEKSLVYRGIDDLKEQIRQAGARTLGEYFATLDPAEQRIRNRYTHRSMYEEEFEAIWEAQRPHHAALTRELKDRLREILFGQRPLRDTEDLVGECEWIPGEKRAPVWSLEYQRSRLLQTVNHLRVAENRCAPRPLTPEERQCLLEELEKKPKVTIAQAKRVLGLQRAEFTIEEGGQKDLPGDKVASQFHEILGQRWLELRPEQQRALVECVASAGSDEQLLEDLKQQWRLSDDQATQIVRNVHLPSGYASLSLKAIQKVMPYLEQGMDVQRARLEARIPLDRPVRVRELLPPLADSGVAVFNPAVKRALTEMRKVVNAVIRRYGKPDEIHLETARELRKSREERMNESKRMRGREKEREEILRRIRDEVGIPEEKISRDDVLKGLLWQECDGKCPYCGESLGGFASLYGGNSPAQIEHIIPFSRSLDNSFVNLTLAHVSDNNYKGDRTPWEAYGSNPERWDQILQRVSVFRGSYSKAKLNRFKMDENAVRELSEQFSSRALNDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHRVTGALHKETFYTRIGQNEKGGDVVRVRMPVTNLGSKEVEAIADPAVRQIVQAELKEVGGDARKLENNWPLLPNRHGKPVPIRKVRVNLNRAVVSVGKGPWQRWAEPSETHHIEIYEVTSRGKTAWSGDVVTMRDAIGR

SEQ ID NO: 478 - protein, 911 aa, unidentified
  REGION 1..911: note = Description of Unknown: uncultivated organism with predicted taxonomy: candidate division Zixibacteria bacterium CG_4_9_14_3_um_filter_46_8
  REGION 1..911: note = MG4-57 effector
MEGKKVGGYILGLDIGANSVGWAILSQKDGKPTGIVKTGVRVFEAATEGDISAGKDESRNKKRRQMRLQRRQAERRARRKRKVFNLLVKSGLLPPGHITGVINDIDKAAYAKYVASADKSARPILAHVVPYILRARALDHPLSREELGRALYHLCQRRGYKSNAKMQEDEKEKGEVKEGIGKLEQAIKASGARTLGEYFSKINPEEERIRQRWTSREMYENEFEQIWEAQKKHYPELLTDALKEKMRDAIFHQRKVTWDKNTIGDCELEPGQKRAVAALLICQRFRFLQRLNDLKIISPLGEIVDLTPEQRRALAEKLDVEGDLSWTKVRKILQLTKEHHFNLEKVSDKGLIGNRTAGKLHKIFGDKWLSFTEEQRNRIVDDVRSFEDRRALALRAMKTWGLTDEKAADLAAVAFEPDYFNLSLRAIRKLLPLLENGMPFATARDQVYGKPKPVEPVDALPVVNEALPALRNPVVARSLTQLRKVVNNIIREYGKPAAIRVELARDLKRSKKQRQTLTERIRSREKLREDARKRLENEKLVERPTRNDIDKVLLADECNWICPYTGRQIGWKTLFGPSPQFDIEHIIPFSRCLDDSLANKTLCDIEENRNVKRNRTPWEAYGSNPEKWGQILDRVRRFKGDDAILKLQRFQLKDVGDFEEFSSRQLNDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRKVNGPLHEETLYTKPRIDKDGNQVVCVRKPLDALSESEAKQIVDPVIRKMVLDRIEKEGAPPKKVFADKSRHPVICGKNGTRIPVHSVRIAKTGSVIPIASGGRSRNIMPGSNHHMEI

SEQ ID NO: 479 - protein, 976 aa, unidentified
  REGION 1..976: note = Description of Unknown: uncultivated organism
  REGION 1..976: note = MG4-58 effector
SGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRNRYTHRSMYEEEFEAIWEAQRRHHAALTRELKDRLWQILFEQRPLRDTEDLVGECAWIPREKRAPVWSLDYQRYRVLQTVNHLRVAENRCAPRPLTHEERWRLLEELEKKPKVTVAQAKRVLGLQKAEFTVEEGGEKELPGDKVAAQFYEKLGESWSRLNPEERRALVECVATAESDEQLSETLQQQWGLSADQANKVVREVHLPSGYAPLSLKAIRAVMPYLEQGMDVQRARLAAGIPLDRPVPVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNPPAQIEHIIPFSRSLDNSFVNLTLAHVSDNAYKGDRTPREAYGSDPERWNEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 480 - protein, 1057 aa, unidentified
  REGION 1..1057: note = Description of Unknown: uncultivated organism with predicted taxonomy: Proteobacteria
  REGION 1..1057: note = MG4-60 effector
MPYVLGLDIGARSVGWALLEKEGDSFTRILRAGVRVFEAGTEGDIEQGRDESRGATRRAKRLARRQIRRRRQRARALYRELSGAGLLPPITPVPGSPMAVLIQEAINRLDCELRRKYAGERAVNQLPYLLRARALDHRLEPHELGRALYHLGQRRGFKSNRKAESGKKAMEDSSKAGEEKSLVYRGIDDLKRQIREAGARTLGEYFATLDPAEQRIRTRYTHRSMYEEEFEAIWEAQRRHHAALTRELKDRLWQILFEQRPLRDTEDLVGECAWIPGEKRAPVWSLDYQRYRVLQTVNHLRVAENRCAPRPLTHEERWRLLEELEKKPKVTIAQAKKLLGLKKAEFTIEEGGEKELPGDKVAAQFYEKLGESWSRLNPEERRALVECVATAETDEQLSETLQQQWGLSADQANKVVREVHLPSGYAPLSLKAIRAVMPYLEQGMDVQRARLAAGIPLDRPVSVHALLPPVADSRVAVFNPAVKRALTEMRKVVNAIIRRYGKPDEIHLETARELRKSREERMKESRRMRDREKEREEIIRRIRDEVGIPEEKISRDDVLKGLLWQECEGRCPYCGESLGGFASLFGGNSPAQIEHIIPFSRSLDNSFVNLTLAHVSDNAYKGDRTPREAYGSDPERWDEILQRVEVFKGSYSKAKLNRFKMDESAVGELFEQFSSRALNDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHRVTGALHKETFYTRIGKNEKGGDVVRVRVPVTGLGSKDVEAIADPAVRAIVRAKLEEVGGNAKKLENNWPLLPNRNGKPVPIKKVRVNLNRAVVSVGKGRWQRWAEPSETHHIEIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 481 - protein, 1111 aa, unidentified; identical to SEQ ID NO: 464
  REGION 1..1111: note = Description of Unknown: uncultivated organism with predicted taxonomy: Thermogutta terrifontis
  REGION 1..1111: note = MG4-61 effector

SEQ ID NO: 482 - protein, 1054 aa, unidentified
  REGION 1..1054: note = Description of Unknown: uncultivated organism
  REGION 1..1054: note = MG4-62 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGG

SEQ ID NO: 483 - protein, 787 aa, unidentified
  REGION 1..787: note = Description of Unknown: uncultivated organism with predicted taxonomy: Planctomyces sp. SH-PL14
  REGION 1..787: note = MG4-63 effector
PAGPASITQAKTAVNKLSDADKKDVAIVAITLDPEGDTRTDQWKRIRGRRTHRAMYVEEFEHIVQRQADFHPVLKDKAFVRRLSHAIFDQRPLKSQASLIGVCDLVPGRRRAAIASLPYQRFRLLQKLNDLSYVDHDGQKKRPTENQIRPLREKLQTEGDLTWATVGRLLGLDRKSKETGLPRLSHEEGGDKKLIGDRTSAKLRRVMAQKLDALSVAEQTAIIDEILSYGDVEEKLAERLRKAWQLTDAEAAEVAALRFEPGYGSVSRTAIARLMPHLEQGTPYATARKIEFGEVEESVPWPLLPPQGDNAKLWKENKKPDRLVYQSFSNPTVARCLSEMRKVVNALIRRYGKPAYIRVELARDLKNSRSRRADLTTRRNRNQARRERAKEAIEKECNNSRPSRFDIEKWLLAEECGFQCPYTGQSIPRHRVLSAEFEVEHIVPFSRSLDNSFTNKTLSHRDANAKKGNRTPMEAFGQPEEKWEQILARVKRFDGPFARRKLDLFQQRTPPEADFYERQLSETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRKLNGPLHKETVFSKPHEASGSAKVFHAVRRPLQLMTKSEVGNIVDKRVREAVLEHLDRHDGDLTAAFGDPNNHPQLPCKDGRTIPIHRARVQRREKPWPIGKKSSKRYVVPGANHRLEIIARLNEEGEEIRWLGNI

SEQ ID NO: 484 - protein, 1054 aa, unidentified; identical to SEQ ID NO: 482
  REGION 1..1054: note = Description of Unknown: uncultivated organism
  REGION 1..1054: note = MG4-64 effector

SEQ ID NO: 485 - protein, 1041 aa, unidentified
  REGION 1..1041: note = Description of Unknown: uncultivated organism
  REGION 1..1041: note = MG4-65 effector
MPEQPKMTYVLGLDLGAESLGWAILETRDGEPVRIERTGVHTFEAGVEGDIESGKDESRAKARRDARLPRRQLWRRAARRRKVLHILQRHGLLPPGEARTPEQIHDLLLKLDADLRAAYLPAGDEVAAHLLPYRLRAKALDEKLEPWALGRVFYHLAQRRGFLSNRRSPERKDEDEGKVKAAIGELAADMKARGARTLGEYLAGLDPRCQGVRRRWTARTMFLEEFDRIWAAQAPHHPCLTEELRGQLRRALFFQRPLKSQKALVGRCELIPDRRRVALALPIAQRFRLLQKVNDLKVREPEGTERFLTPQEREKLARELDDKGDLKFDKVRKCLGLPRGVTFNLQEGGEEKLPGNRTYAKLKAVLGARWGGLSAADREQIVVELLSFQKPEALARRLMKVWNLDEPSATKLAEVRLEQGYARHCRKAIARLLPLMESGVPYATARKEVFPESFAAGTPVDRLPPVTDVLKDLRNPAVCRALTELRKVVNAIVRRYGKPECIRIELANDLKRPRKQREEISKRNRGRQKDREEAAEAIRSALPGLEPRRADIEKWLLAEECNWRCPYTGRSINAAALLGSTPQFDVEHIWPMSRSLDNTFANKTLCYHEENRARKGNRTPLEAYGSDPQRWEEILQSVRRFNGPLAWEKLRRFMAREIPQDFTDRQLQDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRKVAGKLHAETFYSKPIPGADGDVRHVRKELRKLTLGEIQGDRIVDPVIRRLVQERHRQLGGGKPDSVFADPASHPVLRTRDGREVPIHKVRIRSKEKPWPIASGSRLRYVVAGGGTNHHLAIVARPGRRGRGEYWEDHIVSRYTAQQRLARGEPVIQKDWGPGRRLVMVLMPNDFIVMPDDRGVQQVYRVLSISEGDTELRLHCDARRAEDLKKARERVRVSGEKLRKLGGRRVEVSLLGELIGAHD

SEQ ID NO: 486 - protein, 1088 aa, unidentified
  REGION 1..1088: note = Description of Unknown: uncultivated organism
  REGION 1..1088: note = MG4-66 effector
MLQPLQVPYILGLDIGVQSIGWALVRLDEEGNPCGILRLGVRSFESSSGSEQEIEKGTDEPASRQRREKRLMRRQLFRRQQRLRRTARVLQQAGLLPPFPLQPASRDAAITQLDAQLRSQFIDSGNHVDAQLLPYRIRAAALDQPLPAYALGRAFYHLAQRRGFLSNKKAGGKKDEEEKGKVKAGIAELAKQIEAAGARTLGEFFARLDPHQQRIRSRWTSRKMYQQEFDAIWAAQEPHHPQILTAELKAKLYRAIFFQRPLKSQKGLIGRCSLEKGRRRAPLACLEAQRLRYWQKLNDMRLKDARRILNAIPEAEGLIDWLPQEGQGRLSLYAKQLLAQHLETSEELTFNQIRHILGLKKKKNSDLDFTFNLEEGDEKKLLGNRTAARLLKALGQRWQDMPEDQRQRLVDEILSFEKEEPLARRLEKAWGFTPAEAANVAALDFEQGYHSFSRQAIRKILPHLQQGQSLASIIKQLYKDTQPQATAWDRLPPLRDVFPHVNNPVVRRALTEVRKVVNAILRVYGKPQQVHIELARDLKKSRYERQQLFKGMRQQQKQREEAKSWLQCQMGITNPTAHDILKYRLWIECNQQCPYTGKPISKEALFGREPQFDVEHIIPFSRCLDNSFTNKTLCEIAENRNVKKNRTPYEAYGHDPQRWHEILQRVSRFQGDAAKAKLRRFQLTEIPADFANRHLNDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRRLKGPLHEETIYGKPKQYVDEKGKTIQVAHVRKPLESLSPKNVDDIVDPVIRELVKKKLQDLNTTDPKKAFQKKENHPYMIARDGRIIPIHKVRIRVTTETIMTVGHGPTLRHVKPGTNHHMEIVATLDAAGNEIRWEGITVSLFEALHRLRNKQPVVQRDHGPGKRFKFSLAGGEYLEFVENGQKKLVRVTTVYHSNVEFRLHNDARPITMLLGVKGARAGLGHSVDALRKLKARKVLVDPLGNILPAND

SEQ ID NO: 487 - protein, 1042 aa, unidentified
  REGION 1..1042: note = Description of Unknown: uncultivated organism with predicted taxonomy: Proteobacteria
  REGION 1..1042: note = MG4-67 effector
MSISDLSPSYILGIDLGAESIGWLLLDVDGDRPTAIRRAGTHCFDAAVEGDLESGKDESKAKARRDARSPRRQHWRRARRRRRVLRTLQQAGLIPPGPLASPIDIHELILRLDQALREKFIPADDRVAAHLLPYRLRAKALDERLEPFEVGRALYHLAQRRGFLSNRKAGKKGDDEGMVKAAISELSDRMTAAGARTLGEYFSGMDPEEERIRKRWTSRQMYLDEFEKIWTKQAEFHPQMTDEVKAQIHAAIFFQRPLKPQTHLIGVCDCDPPHRRAPVALRLAQRFRLLQKVNDLEVLEPTGFPRPLSSDERAKLIAALEQSGDLTFAKIRGKSILALPKETSFNLEKGGEKKLPGHRTDAKLAEIFGDKWPRLSEAERDQIVEDILTFEKSEALAARAQRAYGLDREAALRLAELELEPGYAMHCRKVLRQLVAKMEGGTRYAAARRELYPDQFQAKPAVDLLPPVKDALRNLRNPAVCRALTELRKLINAIIRRYGKPAEIHIELARDLKRSRKDRQELSKVIRENEKLREKAKERILRELGDQQPTRADIEKVLLAEECGWECPYTGKRFGMQELLGQNPQFDVEHIIPLSRSLDNSFGNKTLCYHEENRNHKRNRTPWEAYHADEQRWHQILERVRRFQGASARGKMRRFLMEAIPDDFTSRQLNDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRRVAGPLHDESIYSPPQRGVGSSPKVVPSYHIRKPLASLSIHEVEDIVDPIIRARVKAVLDEKGGDPKKVFSVAANLPALRTRDGRTIPIRKARIRKSQNMVAIGKGPTQRYVAPGSNHHMAIVAKVDSEGNDREWEGVLVSRLEAAERARRRVPVVQREWGEGRVFRFSLAPGEMFTLEDGNGKGLYIVRSISQNRVEFVKANDARKKVDIKAAKHWLTHPPSVLFRKRCQKVSVGYLGDIVPAND

SEQ ID NO: 488 - protein, 1061 aa, unidentified
  REGION 1..1061: note = Description of Unknown: uncultivated organism with predicted taxonomy: Thermogutta terrifontis
  REGION 1..1061: note = MG4-68 effector
MSAECQVRANEKNYVLGIDLGVLSLGWAVVEYAGDKPVGILKTGARIWEYSDASTLTVQKGQETPPGQERRQARQQRRQIFRRAQRLRRTCSVLQAMGLLDPGRRNSRARKQLWETVDQQAKEWLKSNIPGLADDPQLDHKFVYHLRAAALDHPLPKILLARVFFHLAQRRGFQSNRRVVSRSEEEGEVKKAISLLEHEISESGCRTLGEYFATLDPYTTRIRGRWTSRKMYQDEFERIWSAQIAINPGILDLSQKSRLFKAIFYQRPLKSQKRLVGRCSLEVIVRRGPDGPREVRPRQAALASLEAQRIRYMQRINDLEFTDPEGERRTPTQLEREQLYQLAETVEEISFSQIRKALGIPTGKKGAEWECNLERGGETKIPGNKTAARLRKILGNKTWDGFSESDQKKLVDTILAYLSPEALQSHLENVWKFDSDTARQLSNIELEQGYHSFSRRAIRKLLPLMHQGKRLNEAIKAVYGHTGRLRSVQERLPPVWKVMPELRNPLLVRALTELRKVINNLIRKFGKPQYIRIELGRELKLGKKRRQELAKEMRKREAERERAAKVIEETLHRKARPNEILKYLLADECDWECPYTGKKISVLTLLGDQPQFDVEHIWPFDRTLDDSFGNKTLCYHEENRQVKGNKTPFEAYSDSPDRWREILERVKRFKGPFAKEKLRRFLAADIPQDFPMRHLSDTRWITTAAADYLGYLYGGRIDSEGRQRVFTVTGPLTALIRRGWNLDGILGGPEKNRFDYRQHAIDAIVIALIDQAIVQQISLLSSRLWGTDRPTAVQLPEPWPSFYHDAKNAILNIVVSHRISRRLSGALHEQTHYAPPDNNGRTKIRKPLAALSAKEVENIVDDTIRKYVQHALANAEKKSPKEFFGNPENLPVLKGKNNHVAVVKSVRVWVSAKPVAVGNGDRVRYVKPGNNHHIEIYAIVDEHGNPVKYDGRCVTLLEAVQRKRRGEPVVCRNHGPNTRFLFSLSKNECIEWTNENGEKELLRVVGIADNDIEFRLLYDARPSNLVREAKDRIRGGYSKLFERRARKVLVTPLGEVLPAHD

SEQ ID NO: 489 - protein, 1059 aa, unidentified
  REGION 1..1059: note = Description of Unknown: uncultivated organism with predicted taxonomy: Planctomycetes bacterium
  REGION 1..1059: note = MG4-70 effector
MALVLGLDLGARSVGWALLEKQGDNWTRIVRAGVRVFEAGTEGNIEQGRDQSRGATRRIARLARRQIRRRRQRARALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 490 - protein, 1127 aa, unidentified
  REGION 1..1127: note = Description of Unknown: uncultivated organism
  REGION 1..1127: note = MG4-71 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVIRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIALTSARVVKMLADAARNPEQHRRRRFAPVPPPWPNFKDEVSAAAEKIIVSHRVDRRVAGPLHAETNYSPPIVHENREYRHRRVPLSSITRSQIAQIVDDVIRQLVEQKVGSAGDPAKVFSDPRNLPVLRSRDGTRCIPIKKVRVREHVAATTVGAGPRQRHVVSGKDTLHHTVIVARQTPSGEVWEDNPVDRLEVHRRLRNGQPVIQTDWGSDARYVFHLCKNDCIEMDVESGNPSAGRQIYVVRSISKRDIAVRLHYDARTLEQIVRAKERGKFRISSADLLRRRNARKVMVSPLGEVLPCRE

SEQ ID NO: 491 - protein, 1069 aa, unidentified
  REGION 1..1069: note = Description of Unknown: uncultivated organism with predicted taxonomy: Acidobacteria
  REGION 1..1069: note = MG4-72 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPWPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 492 - protein, 824 aa, unidentified
  REGION 1..824: note = Description of Unknown: uncultivated organism
  REGION 1..824: note = MG4-73 effector
MFSRANSVSDNDCSSVNAPAAPRDTASEAQPQPSQPSAGTNVPYVLGLDIGATSVGWAVLDLDAQGEPCCVRAMGARCFEAGVDGDIEHGKDSSRAVARRQARMARRILRRRARRLKKVFHLLQRHGLLPAGPSRTPEERHRLLADLDRQLFPKYAPGGDRVAAHVVCYRLRAAALDRALEDHELGRALYHLAQRRGFLSNRRDDRRASEKGEKSQDTKVIEKEIASLKEQITASGARTLGEYLSRIDPEQQRIRKRWTSRQMYIDEFEAIWSAQSQHRPGRLTEALKRELRQAIFHQRPLKPQTQLIGRCELEPPRHPGALPPRRAPLALPVAQRFRLLQKVNDLQVIEPDGRIRPLTAEERNKLLQALSEQARMEFDDVRKLLGLSAPRKRKDKATGQQICTPGHRFNLEEGGETSIPGDTTTARLLPVLGDKWRTMPEPLRESLVRDLLDFNYPAALAEHLQRVHRFDRHEAEALSEISLEDGYAPYCRMALRKLVARMENGTPFATARKLEYPQSFAAKPPCELLPPVRRAVPDLRNPAVMRALTEVRRVVNALIRRWGKPEIIRVELARDLKKPRKEREKAWKGNREREKERKAAADRLLKEAGITNPSPADIEKVLLMEECGGICPYTGRPITIPALFGDSPQFDVEHIIPFSVSLDDSFVNKTLCWHEENRHHKRNKTPYEAYSGNRERYEEILRRVSRFSGRFRKEKLRRFQMTLADVKAEYGDDFTARHLTDTRYASRLAADYLGLLYGGTVDAAGRRRVQTSSGTATWYLRSEWDMNAVIPGLSGSPTGSASGTFIEKVRTDHRHHAIDAVAIA

SEQ ID NO: 493 - protein, 1069 aa, unidentified
  REGION 1..1069: note = Description of Unknown: uncultivated organism with predicted taxonomy: Acidobacteria
  REGION 1..1069: note = MG4-74 effector
VSEHLDYVLGIDLGSNSLGWAVIGLIDGEPAQLVRAGVRVFDAGMEGDLESGREESRNLKRREARLHRRLLWRRQRRLTKLFNLLQRFDLLPPAPSISEHLPNGHRRPITPEQRQDLLNQLDRRILSSAWFQTKVNSGAFPEPEHTMPYILRAAALDEPLEPHMFGRALYHLGQRRGFLSNRKQAPKKNDDEGAVKEGIAELRKAMQTSGARTLGEYFSRLNPSTERIRCRWTARDMYEKEFNAIWDAQAPHHADLLTPERKKQIYDAIFFQRPLWLDPGTVGNCELEPGEKRAPAYLLVSQRFRLLQTVNNLRVLPPDDVDMPLTPTDRKKLVDALEMKGDLTFKEISKLLKLEKGYKFNLESGGEKRIKGNRTNADFYAVFGERWLAMSPEERDRAVEYVHSFQKAEKLKDAARKKYDLTEEQAEQLAGISLEADYINLSRKAIEKFLPLLEEGVTYGEARKKLYPESFEAREAMPLLPPVETALAQIRNPAVMRSLTELRKVVNALVRRYGKPSCVHLELARDLKKSKKQRQAISENNRRNESARAKAAEAIIKADVGISAPSPDDIRKVLLAEECHWTCPYTGRSISMRSLLGPEPQFDIEHIVPFSRSMDNSFQNLTLCYVPENRSVKGNRTPWQAYHGDPERYQAILDRVRKFAGDRQTVAAKLRRFTMTDDELEGFLEDFRNRQLNDTAYATSLAAKYLGLLYGGVNDADGRKRVQATSGQATAYFRSLWKLNSILNDGPTSDGGAVPKSRDDHRHHAVDAVVIGLTDAAMIKRLSDAAQRAQLEHRRRFASLEAPCPNFVDSVRTEIDRIIVSHRVSKKVSGALHEETIYSRPMGKDGEVRVRKPLDSLSRPEVEKIADEGVRKLVQQKLEQLGGIEPKKAFPNPENLPRFPSSGVVIKNVRITKPLPIFTLSEGRRARHVTSESNHHVEIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 494 - protein, 1059 aa, unidentified
  REGION 1..1059: note = Description of Unknown: uncultivated organism with predicted taxonomy: Proteobacteria
  REGION 1..1059: note = MG4-76 effector
MALVLGLDLGARSVGWALLEKQGDNWTRIVRAGVRVFEAGTEGNIEQGRDQSRGATRRIARLARRQIRRRRQRSRALYRELASAGLLPEVTPSPGSPLAVLIQQAINDLDEHLRQKYAQESAVSQLPYFLRARALDHRLEPHELGRVIYHLGQRRGFKSNRKAEAREKADGDPLKEQKDKSVVYREIEELKAQIQDTGARTLGEYLSRVDPAVERIRHRYTQRRMYEEEFEAIWEAQRPHHAALTRELKDRLWDILFKQRPLRATDDLVGECDWIPGEKRAPVWSMDYQRFRLLQAVNHLRVSENHSAPRPLSSEERLRLLDVLETQSKISFAQAKKILGLRKAEFTIEEGGEKNLPGNAVAAQFYEKLGQDWIRLKPEDRQALVECVAVAESDEQLLEALKQQWGLSEDQARRIVQEVSLPSGYARLSLKAIRAVMPYLEEGWDVQRARIEAGIPLHRPVELHDLLPPLADSGVAVYNPAVKRVLTEMRKVVNAIITHYGKPDEIHLETARELRKSREEREKDSKRMREHEKEREAIIRRICEEIGIPETRISRDDVRKAMLWEECNGMCPYSGRSLGGFASLFSGNSPAQIEHIIPFSRSLDNSFVNLTLAHVSENAYKGDKTPWEAYGANPEQWDRILQRVALFKGSYKKAKLNRFKMDSNAVGEFLEQFSSRALNDTRAAAVAAARYLALLFGGETVGGKLKILKITGQVTAHLRDAWDLNGLIPSIHRETRGEAADKEPKTPPLKSRDDHRHHAVDAVVVALCDQGSIHRLSEASKTAVAARRRLLAPMAPPWVGFREQLKDILKSMNISFRPDHRVTGALHKETFYTKLGQNQKGGDMVRLRVPVTSLSSKDIENIADPTVREIVRAKLEEVGGDAAKLEKNWPLLPNRNGNPVPIKKVRVNLNRAVVSVGKGRWQRWAEPSETHHIEIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 495 - protein, 1057 aa, unidentified
  REGION 1..1057: note = Description of Unknown: uncultivated organism
  REGION 1..1057: note = MG4-77 effector
MALVLGLDIGARSVGWALLEKQGDEWKRIVRAGVRVFEAGTEGDIESGRDHSRGATRRIKRLARRQIRRRRQRARALYCALAEAGLLPEISPQPGSPMSLLIQQQINRLDGQFRIKYAAHPAVQQLPYLLRARALDQPLELFELGRVIYHLGQRRGFKSNRKAESRKAGAGDHSRAKEEKGKVYEGIDALRTLIDQAGARTLGEYFSRIDPAKQRIRGRYTHRSMYEQEFDAIWAAQKPHHPALTQELKDRLWNILFQQRPLQDKEEFVGECSWFPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELRQVLRSMNISFRPDHRVTGALHKETLYKYVGRNERDGDVVRVRVPVHTLSVRELGQIVDPNVRVIVQAKLAEIGGDLKKLENNWPCLPNRNGAPVPIRTVRVDLNRAVVTVGTGFRQRWAEPSETHHIEIYEISENGRTVWTGDVVSMREAILRAARGEPVVRRSAGANGRFLFSLAKEDTIRLFGDRAGIWVVKKIKGNEQIILVPQHDARKEGSGAASRTEFAPTAGGLRRYSAEKVTTLPIGDVVPCHE

SEQ ID NO: 496 - protein, 1031 aa, unidentified
  REGION 1..1031: note = Description of Unknown: uncultivated organism
  REGION 1..1031: note = MG4-78 effector
MLIPNDSLVLGLDIGSSSVGWSLIQNRGEAVEIVASGVRVFPWTVDEQTLMSRSVERRRARQRRRQLERRARRRRLVASLLQRQGFLPPGPPDHRDPSWKAVLAMDPYELRGRALETRLEPWEFGRVMYHLAHRRGFAGSGRGADDSETGVIQEQIEKTAREMQKVNARTLGEFLAQLDPRERRRRGWHTAREWYRTEFEAIVQAQQRMGLNLDPDWVKRLRRAIFFQRPLRTSPRAVGRCGLVPGRLRAAWGLLEAQRFRYLQKLNDLRVLLPDGQVRPLTPQERELVRGELERSERLTFDRLRRLLSSCDPSEALGEPSTGKAGNCDEDPGARSTSDFSRQKAGLAFNLECGGQDCLPGNTTAARIRSAIGQKWDQASEDVRRAMVELLLGVKDRKLRARLALRRKEWALSDLEAERLAQVNLEPGRCRFSSAALRRLVPHLEAGCALTEAIAREFPEHEARFRTEADPPPETPVTNPLVRRALAETRRVVNAIVRTWGLPGRIHIELARELRKPLRRLRELLRRNEERQRQRKHAIKYLIEKGIQDPRPDQIEKFLLWVECKQICPYTGQSISDVDLFGPLPRFDVEHIIPWSRCLDDSFANKTLCEVDHNRNRKRNRMPTEVYSQDELSQILRRVRAFQGPYRFEKLRRFQMTEADLTTETGWLLRGDQLQATAHAARLAGRLLGRWYPAEERLSRIQITNGAVTSWLRVAWGLNQLLGVADEKNRSDHRHHLVDATVIALTTAATVKALTEAARRSARPRRFVDMPVPPGLVDSLRQQLETVIVSHRVDRRVQGPLHEETFYGRIQTPPTGESRTVVRKRIDALSATEAQRIVDPRVRELVAQVCNGRAPKEVFRDPSLIPEVPFGSRKVRIRHVRIWVSENPISLKDGDPRLVLPGSNHHLEIFDCREGPRPGWRCVVVSRWEAMRRLRAGKPVVRRFDEHGCPLVCSLARGETVRLNLPGGPVIAVVQKLSQDDYNFRLHTDGRRAADIPASERIRIRSSKALKKCLGCKLVVDVLGRCHVSRD

SEQ ID NO: 497 - protein, 1031 aa, unidentified; identical to SEQ ID NO: 496
  REGION 1..1031: note = Description of Unknown: uncultivated organism
  REGION 1..1031: note = MG4-79 effector

SEQ ID NO: 498 - protein, 1063 aa, unidentified
  REGION 1..1063: note = Description of Unknown: uncultivated organism with predicted taxonomy: Planctomycetes
  REGION 1..1063: note = MG4-80 effector
MLAGKTHPSGSRTAASEYLLGLDIGTTSIGWALIALKNEEPCGILRAGVRCFEAGVEGDIEEGKDSSRAKPRRIARLARRQIWRRAARARKVFRVLQELDLLPPGEARSPHARHALLHALDQKLLQKYDLARDHVKAHLLPYLLRAWAVKRRLERYELGRALYHLAQRRGYQTNRRAEADNDDEDNEKQRKIVQGSIETLQQDLAGRTLGQFLATLDPCQRRIRQRWTSRSMYQDELARIWQRQAAALGLTEEDRKQLYKAIFFQRPLRSARGLIGQCDLETGQRRAPLASLVAQEFRILQQVNHLRVRLPDHTERPLTDQERATLSQILMHQEELSCAEARKLLGLTKHGTKFTIELAREKSLRGNRTQARLVAVLGPRWDTFTPQERNELIWDVIHYEKAAALARRAQKRWGLDPQTAEKLANVRLETGYAAHSAAALEKLNERMRAGEAYATAKQAVYPHAHQPDRVVSRLPPVKEALGELRNPAVLRALTELRKVVNAILRRYGKPKAIHLELARDLRRSRKEREKISAEQAKREKARRDALQKMLREFPNYQPKRGYDPAIEKILLAEECDWECPFTGKKINMQTLLGKSPQFDVAHIYPRRYLDDSFANKTLCYHEENRHRMLDRLPMEAYAGNPQRWQEILARVKRFQGPYAAEKLRRFQTEKVPDDFVSRQLNDTRHSTKLAAQYLGLLYGGPYDAQGHRRLVAVSGSITAHLRRAWRLGVHPGPDQAGPGKNRDDHRHHALDAIVVALTSHATIQKLSTFAARSQPGQQRLITGDLQEPWPSFQRDVRQALMAIYVSFRAEHKLAGPLHAETNYSPPIPTPDGKFVHHVRKSLSKLTETEIRGDAIVDPVIRALVQKKFEELGGKQPEKVFADPANHPYLTARDGRRIPIHKVRIRARANPVRIADDPARQRWVAPSGNHHAVIVAQLDPQGRESRWEDHVVTRLEAHQRLRQAGPRPRNQLIQRDWGPGKRFKFSLMLNDMLELDAPGGGRQVCRVLGISKGDYELCLHYDARSQTEIARQKQRIRVNAEKLRLLRARKVVVTPLGDIQPAGG

SEQ ID NO: 499 - protein, 806 aa, unidentified
  REGION 1..806: note = Description of Unknown: uncultivated organism with predicted taxonomy: Rhodobacteraceae
  REGION 1..806: note = MG4-81 effector
MALVLGLDIGARSVGWALLEKQGDEWKRIVRAGVRVFEAGTEGDIESGRDKSRGATRRIKRLARRQIRRRRQRARALYRALAEAGLLPGISPQPGSPMSLLIQQQINALDAQFRARYAAETGVHQLPYLLRARALDHPLEPFELGRVIYHLGQRRGFRSNRKAESRKAGAGDESKANEDRGKVYEGIDSLRTAMQQAGARTLGEYFSRLNPAEKRIRGRYTHRSMYEQEFDAIWTAQKAHHPALTREFKDRISDILFRQRPLQDKEEFVGECSWLPGEKRAPVWSLEFQRYRIWATLNHLRITGNRSAPRPLSPEERALLFTSLDAAEKLTIAQAKKALGLRRTAGFTLEEGGENHLPGNKVGAKFHAILGNRWTSLPPEKQNELVTVVARASTDEELEEALQRDWGLDGEMSRRIVREIVLPSGYALLSLRAIREVMPFLQQGYSVQEARQKAGIPLERQVPVHPLLPPLADSGVAVFNPAVKRTLTELRKVVNAIIRHYGKPDEIHIETARELRKSREERAEDSKRMRGREREREAVRDQIHKEIGIPLDQISREDVLKGLLYRECEGMCPYCGQSLGGFASLFGGNSPVQIEHIIPFSRSLDNSFVNLTLAHVSDNAEKGNRTPWEAYGHDPGKWEQILQRVGAFKGSYAKAKLNRFKMDEQAVADLLQQFSSRHLNDTRAAAVAAARYLALLYGGETVDGKRKILKPTGQVTAYLREVWGLNGLIPSIHREAAGAEESDDGRTIRKSRDDHRHHAIDAVAVALCDQGTIQMLSEANRGAAAARRRRFAPVPPPWVGFKDELR

SEQ ID NO: 500 - protein, 1081 aa, unidentified
  REGION 1..1081: note = Description of Unknown: uncultivated organism
  REGION 1..1081: note = MG4-82 effector
MESKRLKQPFVLGIDLGVQSLGWAMLSLDDDDNPTGVVRLGVRCFDSGVGSEEEVAQGKEQSQNVERRGARLLRRQTWRRARRIAKVFHALQRFGLLPAEPAPTPEQRDALIKQLDADLRAEFLPAGDRAAFHLLPYRLRALGLDQPLPPFAFGRALLHIAQRRGFLSNRKAEGKENEKERSVVKESISFLQNELVRTGARTIGEYFAGIDPEEQRIRGRYTARQMYLDEFEKLWAVQAPHHQLDESAKKAIHQAVFFQRPLKSQSGLIGLCELEPGQRRAPAASLEAQRFRYLQKVNDLQIITPDGFILAPSEEQRRSLIDYLEHHAEITFDKLRTLWGLKLPRKSKKKSPAASGSDGDSDLASDAAQSDERPGYNFNLERGGEKKLKGNVTRARIEAALGCDLDELPAHVREPLVADVLEYENADALQRRLVQRYGLAEEQAAALAETHFEDGYASLSLAALRKFLPLMEQGMPFATARKELYKDSRQFQPHDILPPLFMVKAQLRNPAVSRGLNELRKVVNAVIRRYGKPKYIRIELARDLKQPRKVREERSKSMRKNEALRQQIIDDIRRFGIANPSETDILKVRLADECNWQCPYTGKAISMETLLGPHPQFDIEHIQPYSRSLDNSFTNKTLCDVHENRIAKRNLTPFEAYSGDEQRWHEIIARVRRFRGPASPAKLRKFLAKAIDSDFVERQLVDTRYMSRAAAEYVGLLYGGAVDSQGTRRVQVSPGGVTADLRRLWGLNRVLPRDPGDDERPGKKSRSDHRHHALDAAVIALTSPAMVQQLSRCAQDALLIGSRRFVALELPFPSLIDDLKKAIDEIVVSYRVKRKVRGRLHDQTYYSPPKPACDENGRTVEYRHVRKPLASISADRIEKIVDPVVRKTVQEHLARHGGDLKKAFGNPNNLPYLTAGDGRIIPIRRVRIRENISVLPIGKPPQLRFAAPGTNHHMEIVEVTDARGRVRWEGKLVNMFEAYQRRRQHLPVVCRDHGPNANFLFSLACGEYVEMEHVPGQRKVYRVTTISGERLEFRLHCDARPITVLKKLPKARINRSASTLLEAKARKVFVDPLGNVYPAGD

SEQ ID NO: 501 - protein, 1045 aa, unidentified
  REGION 1..1045: note = Description of Unknown: uncultivated organism
  REGION 1..1045: note = MG4-83 effector
MKTEYQKSGSVLGLDIGPTSVGWALIEENEQQPCRLIDMGVRIFEAGVEGDIESGRDESRAAKRRMARLHRRQLERASRRLKVLAEELQRRGLLPPGDVSTPDARKRFFDELDKLLAQGLDNPALLPFILRARALHERLDPHETGRALYHLAHKRGFLSNRKSQPKEDEELNTIAQAVGQLRQAMQETGAQTPGEHFAALLRNNGRVRGHHTFRNMNAQEFDLIWDTQRAFHPDVLSDEARKSIGKKIFFQRPLKSNKGLTGRCELEGARRAPLALLVSQRFRMLQKVNDLRLVSPDGLQRELTASERAELLRHLELQQNMKFTAIRKKLKLQGKFNFEIGGEESLPGNRTAARMASVFGQQRWQSMTPGEQDLAVQHVRSIRKPEALERAAADYWKLDPNAARAFAKISLEEGHVMLSQKAMSKLLPLMERGMPFATARKELYGAAPPPRAYDKLPPVHSPEMPAVTNPAVRRALTEMRKVVNAVTAKYGKPGLIRIELARDMKRPRKARQQISKRIRANKNKRDAARQQLLKEASGALGSAWEPKRSDIEKWLLRDECGGICPYTGKPISFHSLFVEPEFDIEHIIPFSRSLDNSFLNKTLCCATENRIKSKRTPWEAYGGTARWDEIIGRVRKFTGDANVAKLQRFQIRDADKEIDGFAARELNDTRYISRLAVQYAGLLYGAGADGVDPSGRRRVQAARGQITAHLRDVYELNSLLGDGGEKYRGDHRHHAVDALCVALTTPRAVKQLSDAAAAGEDRRRAWYDTRLITDPWPGFLDDARNAVNAIVVSHCPSRKVNSAMHDETVYSKPHADPMGRACVHVRKPLAALTDKMVDNIVDDRVREKVRQALNGRAPKDAFKDSASLPFFETRDHRRIPIKTARIRVYQSVNSLGRNAAARNVVPGSNHHVEIFAVEQEKGGVKWEGRMVTTIEAMARLHPKSRIPVVNRAHENGGKFLFSLSPGDTVRVTLDGEQKLLRLRTISKNNQGRLRLDAVCIREARKKAEIMQDKKWIIFPTLHALADMQFQKVTVTPLGEVFPCND

SEQ ID NO: 502 - protein, 1077 aa, unidentified
  REGION 1..1077: note = Description of Unknown: uncultivated organism
  REGION 1..1077: note = MG4-84 effector
MADPGLLKYVLGLDIGANSIGWALLTARGDERLTPTGIVQTGVRIFEAGVEGDLERGREESRGIQRRLARQARRRLDRTARRLAKVFGLLQDAGLLPRADTPASLPGVGVPREHMTARERRDERLRASAERDALLAQLDRELVAQCQDGLRAAGASQGEIWLVPHRLPYLLRARALDNKLPAHQLGRALYHLAQRRGFLSNRKAAPKKDEDQGVVDQGIQKIVAGMRETGARTLGEYFSRLDPTGERIRGRWTSRAMYQDEFDAIWAAQAPHHPEILTADLRKRLKRAIFYQRPLKVQKELIGECEFEKGRKRAPMALLVAQRFRLLQQVNNTRILTPDAVERGLTAEEAGKLIDALDTLGDITFKKAKRLLGLSQQHVFKFESGGEDKFIGNRTATKLIRVFGLDRWKTLKPSDRDRIVDDLLTIQKPETLARRAQRVWGLSPEAARELARTSLEDTHCRLSRLAIKNLLPLMETGMPYMTAARQVYGEKPAEPPRDSLPAVSEALPALRNPAVHRALTELRKVVNAIVRTYGKPAAIRIELARDLRKSPKQREQTWKKNRDNEALRKDAAEKLFREMGIQNPKRSDIEKMLLLQECGCMCPYTGKHISMRDLFGDAPQFDVEHIVPFSRSLDDSFLNKTLCEVAENRNVKGNRTPWEAYGHDLVRWNQILQRVSHFQGSAQREKLRRFQLQTIESPEQFASSQLNDTRYAAVEAMDFLKLLYGEEAQRKVIVQAARGGTTRFLREEFGLNQILGDGGEKSRDDHRHHAVDAICVALTDPATVKMLSDAAARALSEGRRRFASVPFPWGRFLDDVRASIQGINVSFRVSRKVGGALHEATFYSPPKKDPKTGQEHVHVRKPVTALSEQRVGNIVDPVVRAAVQAKLKEVGGDVRKLADNPPTLRAKDGREIPIRKVRLRESITPFGIGQGGARQVVTDTNHHVEIVQVPGKAGQPKWEGCVVSQYEALRRLRAKEPVVRRDHGNGRTFVFSLALGETVQMKGDDGQLALFKVAGVSQTGRGQIMLEFRRNADARPATVLRKIKGGRVFRTPDSLRSAMGTKVLLTPLGELRRVGRD

SEQ ID NO: 503 - protein, 1031 aa, unidentified; identical to SEQ ID NO: 496
  REGION 1..1031: note = Description of Unknown: uncultivated organism
  REGION 1..1031: note = MG4-85 effector

SEQ ID NO: 504 - protein, 1031 aa, unidentified; identical to SEQ ID NO: 496
  REGION 1..1031: note = Description of Unknown: uncultivated organism
  REGION 1..1031: note = MG4-86 effector

SEQ ID NO: 505 - protein, 1045 aa, unidentified
  REGION 1..1045: note = Description of Unknown: uncultivated organism
  REGION 1..1045: note = MG4-87 effector
MSSGYVMGIDIGVASIGWSVVEPGSEERPGRIVRLGTHLFEPGVDGTQTAIEQGKDEPKGAARRGARQVRRQLWRRAHRKRKLLFALMKHGIMPHATVPDGAAIDAYIKALDSRLRAAWCRAGDHQAHQIMPYLIRSAGVQRKITLEEFGRALYHLAQRRGFLSNRKAKKKKDEDTSQVKAEINELQSLIDRHVPATLGAYLASLNPDEQRLRDWWTARSMYLHEFEALWTEQSRHHRELTDEAKAAIHRAIFHQRPLKSQAHLIGRCSLEPGRKRAPLAHREFQYYRVLQGVNHLTIAPPGEAARKLDAAQRKVLTDALLAQGDLTIAKVRTLLKLPKGTDIAGERGEEEKKIVGHRTDAKLRDAIGPRFDAMSDRERDQLVLDLRSFRETEPLIGRLKSHWGLSDEQARKVADADLEEGYASYSLAAIRRLIPHLERGLSVSEARKAEYPESFRATQVHDLLPPVTDVMGDLRNPSVMRALTEARKVVNAIIRRYGKPEKIHVELARDLKHGRDRRAAITKQIRQREKQHADAKHRILAEIKGYEPTRIDREKVLLADECDWRCPYTGKKFGMKELIGEHPQVDVEHIWPFSRSFDNSFMNKTLCWHDENRRVKRGRTPYEAYSASPERYQEILGRVLAFKSDRRTVSEKFRRFTAEAIDEDFTNRHLSDTRYIARAVSEYLGVLYGGRTDADGKQRIVACSGGLTSWLRREWGLDALLSPTGDDAEAEKNRIDHRHHAVDALVVALTTPRTQAMLQAAAARQEQEGRFRLFGRIEPLWSAFPREAKAAVEAIVVSHRQQRAVSGKLHAESNYSKPIHGGHRIRKELHKLTRNEVSRIVDPRCRALVEAQLEKLGVDDPAKAFSKRENCPVIKGRDGVERRLRRVRLFSTASPTIVGQNARIRYVEPDSNHHCIVWAKRTKEGEEGPWEFEPVRLLDAYDRVCRGLPVVNRDGGSDRIFKFSVSINEFIEMDDPDSGGRQLYRIKKTSLREIGVQLHHDARTVDEVRKAGDLNKYRISPSALKSRNARKVFVNHLGEVSGAGG

SEQ ID NO: 506 - protein, 834 aa, unidentified
  REGION 1..834: note = Description of Unknown: uncultivated organism with predicted taxonomy: Planctomycetes bacterium
  REGION 1..834: note = MG4-88 effector
PREERIRQRWTSRPMYLNEFARIWSVQADAHGLTEEDRQRVFKAIFFQRPLKSQKGLIGRCELEPKHRRAALAMLVAQEFRILQKVIDLRVRFPDGTTRPLTADERQTLIDALQQVGEMTSASARKLLGLNKKGITFSIEEWGEKNLPGNRTNAKLAAIFGRRWLQFTPEERDQIVLEVLHYQKPAALVRRAMKHWGLDRQAAEKLSETRLEAGYARHSLAALTKLNASMRTGMPYMTAVKEAYPARFQAGKPMKLLPPVVKALRDLRNPAVCRALSELRKVVNAIVRLYGKPEKIRLELARDLRRSRKDRKRIAEQQREQETRRRKALERMMREFPNYQAKAGFDPAIEKILLAEECNWECPFTGRKIEMATLLGKNAQFDVAHLFPRRYLDDSFLNKTLCYHDENRHRMHDLLPKQAYGGDPQRWAEIIARVKAFKGSAATLKLERFLAAEVPEDFVESQLNDTRHNSKVAAEYLGLLYGGLWDASGKRRIEAITGGITALLRNAWRLRKDRADHRHHALDAIVLALVDPAQVKSLQESAERASEGSARFRLGELDEPWPGFRDAVRSALEEINVSIRADRKVGGALHAATNYSKPVRAANGSAVHHVRKPLHKLSVTEIEGDAIVDPVVRAAVQQRFADLGGKDPQKSFSDKANHPTLTAKDGRSIPIHKVRVRVREKAKMIAKGTVRQRFVTAGANSNHHCVIVAVLDAAGKETKWEEHIVDRLEANKRRASAPPGGMIQRDWGPARRFKFSLMPNDMLEMADESGTRQLYRVANISKGDYELRLHTDARESKELRSLKQRIRVHAEDLRRGRARKVTVTPLGEIQPAGD

SEQ ID NO: 507 - protein, 795 aa, unidentified
  REGION 1..795: note = Description of Unknown: uncultivated organism with predicted taxonomy: Planctomicrobium piriforme
  REGION 1..795: note = MG4-89 effector
MGFLMDASVSYGLGLDQGVASIGWAIVRLDAKGKAIGVERLGVHLFEAGTEGDIEGGRDESRAGPRRMARQARKQYRRRVLRKKRLLRWLQELGLMPAGDISTAEGRDKLLKDLDADLRTRWEADASIDHRLRQLLPYRLRAAGLTRRLEPFELGRALYHLAQRRGYLSNRKAQGASADPCAAGDATKPKKAGKGKKGTPAPPAEHAPAQPGASASPGEDQAGKGSGEAGGKEDPGVVRAAIVELERQMRGAGCTTLAEYFSKLDPTGTLGDRLRGRWTAREMFLEEFGRIMAEQAKHHPALTNEVQRKLHRAIFFQRPLQSMSHLIGTCDLVKGAKRCPLGHRLAQRFRLLQRVNDLDIRLPDFTRRPLTTEERGRLLAALDREGDIAFSTLKRKDWFGLPKGSTFNLEEGGEKKLVGNRTEAKCRCIFGDERWDAMSEADRDAVVHDLIVFEKPSALARRGESVWKLSPQRARALGDCVLEPGFAAHSKEALAVLVPCMEEGTPYAKAVQDKFKKVDATAEVRDRLPPVEKALGNLRNPTVTRALTELRKLVNAVVRKYGKPAWIRLELARDLKRARKQRERLSKEMREQEARRDSARAAIVRKAGLAGPSRSDIERYILAEECGFICPYTGKPMDRERLTDLVGRTPQFDVEHIWPLSRSLDDSYLNKTLCHVEENKAKGNRTPFEAYSQSPERWEQILDRVKRFGGTAARIKLERFTAKEIPDGFAERHLAETRKIGAASAGFLGLLYGGEIDAAHKRRVFVTTGGLTAHLRREWHLNGILGTEGEKARDD

SEQ ID NO: 508 - protein, 1097 aa, unidentified
  REGION 1..1097: note = Description of Unknown: uncultivated organism
  REGION 1..1097: note = MG4-90 effector
MSTPSNVPYVLGLDLGVASIGWAVLDTDAKGRPTSIRAAGSHLFEAGVGGGSQSTPEMAMARGKEESKAAPRREARAMRRQTMRRARRKKKLLGALIRHGLLPEGDIRTPAAIDAYVKALDAALRATWCPPGSSHVEYQNMAYRLRAEAAQRPLDAHAVGRALYHLAQRRGFESNRKTPKRDDEDTSDFQNKLDDLGDAIRSHTTQTLGAYLASLDPDEKRLRGRWTHRSMYEQEFETIWDAQAGALGLDGGAKQDIHHAIFYQRPLKDQSHLVGRCSLVPGKKRAPIAMRIAQDFRVLERVNHLRIVHDDHSERPLSKDERDNLLAALRREEKLTMHQAKKAAGLPTKHVKFSIEAGGETKLVGHRTDAKLCKIFGDRWDEMSEQEKDTVVEDVRCVRLPDTLRRIGEVRWGLSREKAQELADVQLEEGHSAHCLRALRKLVARMDADGLAYSTARKDEYPASFQSVEPMDLLPPVDAWEKDLRNPAVSRALTELRKLVNAIIDRHGKPVRIHLELARDLKQSRKKRKTASDRMRTREKEREKAAQRIITQPGLGIQHPKRWQIEKVLLAEECNWRCPFTDRGFCMADLLGSTPQVDVEHIWPYSRSMDDSFLNKTLCYHEENRNRKRGHTPMEAYGPTPEQYEAILDRVRRFKGDHFAVREKLRRFTDALDEDFPLRHLQDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQRVRGPLHKDTIYSPKIDGKHRVRKELHKLTAKEVQSGKIVDTRALAAIQAKLAELAKTDPALADPAKAFKAPENAPLVPGPNGSKVRLRRVRIDTGDKPTRFGGAKGKGSARYAKNELNHHVAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGGWARARLRRSARAPFRSPRAAGHPRRRRTRGHHAIGRGRHRRGR

SEQ ID NO: 509 - protein, 930 aa, unidentified
  REGION 1..930: note = Description of Unknown: uncultivated organism with predicted taxonomy: Deltaproteobacteria bacterium
  REGION 1..930: note = MG4-91 effector
VSSQPRRQGYILGLDLGIASVGWACLEHDGQGKPTGILAAGTHVFEAAVENGQAADQTPAAKRRAVRSQRRLLWRRRQRRRKTARLLQQAGLLPVGPMDTSEELDKLIKDLDADLAKRWSGRVPPSRRDRLVYHIRAAAAQGPVEPDELGRAIYHLAQRRGFKSNRRTDRKADDKEIGKVKEGINELRRLMHEAGARTLGAYFATVDPHERRIRNRYTHRAMYEEEFEAIWSAQQPHHAVLTPELHDALHDALFFQRPIRKQPGLVGMCSLVQGKRRAPKALRAYQRFRMLQGVNHLRVDEPGRSARPLTAEERKKVIEALEREGDLTFAKLRQKKLLALPKEVEFDLAQAQFDRGEDKKGDRKIIGHRTDAKLRKVLGDRFDALTEEEKDQLVHELRSIPTEEGLIRRATRHWHFTMEQAEQLADLQLEDGYAALSLTAINRLLPHLEQGLSYAEARKREFPESFKSEDALDALPPVDKAIDNLNNPSVRRAMRELRMVVNALIREHGKPGRIHIELARELKHGRSRREQTERRMRERAKQREAAAETIIRETTARGFRIDKPRRDDIEKYLLAEECGWICPYTGRSIGWESLFGPHPEFDIEHIWPFSRSLDNRFLNKRLCHAATNRSVKKNRTPYEAFGQDTEQWEQILDRVRRFKGDPYARREKLRRFEAQEIDEGFLERHLRETSYFARLAQEYVGLLYGGIVDAEGTRRVIASSGGATHWLRRELGLDSILSDDEEKNRSDHRHHAVDAITTALLDSRTIQLLARAAQEAEERGSRRLFLSLQEEPWQGCRRDVEEAVARINVSHRQRRRVRGPLHEETNLSELINGGHRVRKALASLSPAEIKSDRIVDPRARELIRRALEEHAGGEITKKTITQVFSDENNLPLVPGPGGRLVRIRHVRVEVRDKPTLFGRDASRRWANTGS

SEQ ID NO: 510 - protein, 1062 aa, unidentified
  REGION 1..1062: note = Description of Unknown: uncultivated organism with predicted taxonomy: Alphaproteobacteria
  REGION 1..1062: note = MG4-92 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRQLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPEHYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQADIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTHDAIERELLRRECNGVCPYTGREISPSQLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEDLKQVRLLPEIDPPWAGLLNDTREALARTIPSSRVDRKANGKLHEETIYGRILHKGEERTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 511 - protein, 1062 aa, unidentified
  REGION 1..1062: note = Description of Unknown: uncultivated organism with predicted taxonomy: Proteobacteria
  REGION 1..1062: note = MG4-93 effector
MTNGNLGKERFILGLDLGTNSIGWAMVGLDDNDKPCSVIRTGVHVFPAGTQGTDEDFAQGRDESRAQRRRMKRLLRRQIYRRKARARDAYKHLAEYGLLPKLEGYKGQNRDKAIKRLDVELLDRYLTAHPELIDEYELRDRVTAQTLVYRLRKEALDRPLQPDELGRILYHLSQRRGFKSNRKAPMKEDEKPGEVKAAIESLADEIKSAGARTLGEYFAGLDPEQRAIRRRKTDRSMYEQEFELIKKAQAPHHQRLDEKFWGRMRRILFYQRPLKSTKGLVGRCPLEPPRRRAPMASPAYQEFRLLQKLNDLCWIEVETGDSFALVDHPELYETLYDALHKTDYLKFTEIAKLLKLKRNGKERTRFNLEAGGEKGLYGNRYASLMYQLFGENWQKEPSSCLSGIWQDLRSIQNETLLKRRAEEKWGLDASQIEILLQTDIEEGYAAYSAKALQKLNQEMAQKIPFATALKSCYPEQAAEECVDLLPPYAEVGSDLRNPVVNRTLTELRKVVNAIVRRYGKPEKIRLEIVRDIKLGRKRRAEISKKMRTRQSEREDAKEQLRQWGVPVTRDAIERELLRRECNGVCPYTGREISPSHLFGESPQFDIEHIIPYSRSLDNSFANKTLCWHATNRNRKRGKTPYEVFSQDGDWEVILRRVAAFKGGYRDEKLRRFKLADLSEFDDFERRQLTDTAYAARLARDYLGVLYGAESLRRIQVLPGRLTSLLRGAWQLNRILGDPERNTKSRADHRHHAIDALVAAVTDRSMVQKICTRAKQLEELKQARLLPEIDPPWAGLLNDTREALARTIPSSRADRKANGQLHEETIYGRILFKGEEKTVLRRPLEALSSKEIDNIVDECIKDRVVQALEASGEKNPNKAFANPANLPRMVVRDRNGRSREVFIRRVRVFRSDNPVPVGRDRRLVKTGGNHHMELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 512 - protein, 1039 aa, unidentified
  REGION 1..1039: note = Description of Unknown: uncultivated organism with predicted taxonomy: Planctomycetales bacterium 4484_113
  REGION 1..1039: note = MG4-94 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDPVIRRIVQQKLSELGESDPKKAFKDAANLPLDPQGRVVRRVRLKRNLEVFPIAKEEHRRRYVVLGNNHHMEIVGVGEPDEHGEHPKWEAHVVSMFEAYQRKKNKEPIVKRDWSDETEKDGKPRKFLFSLAGGDTIELQKEEGKRELFIVRTVPQMKQVRFVPINDARRLKDIGKVGFTAYPETLRKWHCRKVAVNPIGEVHYQND

SEQ ID NO: 513 - protein, 1072 aa, unidentified
  REGION 1..1072: note = Description of Unknown: uncultivated organism with predicted taxonomy: Planctomycetes bacterium
  REGION 1..1072: note = MG4-95 effector
MTNQEAEEKYILGLDLGSNSVGWTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 514 - protein, 835 aa, unidentified
  REGION 1..835: note = Description of Unknown: uncultivated organism with predicted taxonomy: Planctomycetales bacterium 4484_113
  REGION 1..835: note = MG4-96 effector
MEDSPALLGIDIGPNSIGWALLDSEGKAIDDMGARVFEAGLADIEQDGKGKSRNVERRDARCIRRRLERTGRRLSKLARILQDAGLLPPGDVLSDEKRHQLVKRLDAQMDSPYSLRAKALDEKLKPYELGRALYHLAQRRGFLSNRKSAPKDEKEEGVVKEGIGQLRRDIDEAGARTLGEYFAKLDPHQQRIRGRYTSRKMYEDEFKMIWQEQRQYYPDLLTDDLKKAIHSAIFYQRPLKSAKHLIGGCQLENGKRRAPWALLIAQRYRYLSVLNNLTIRLPDGSERELTADERSKLIDYLEKNAELKFTTARGKKLLALPRGTKFNLEEGGEKRMLGNATAAKLRKIFGDRWDSFSEEEQDQIVEDIRSIVKDEALVKRGITKWGLDEESARKLTEVQLPDGYCRFSRKALEKLVPLLEQGKRLQTAIRELYPEKWARGSQPLDSLPPLSQCEDPALSELRNPIVSRALTEIRRVVNGVIAKHGKPDVIRVELARDVAQPAKRRQQAWKQNRQQERARKDAAERITKEAGIEKPSRDDILKVLLADECNWECPYTGRRINITELFGEHPQFDIEHIIPFDRCLDDSYVNKTLCEANENRNIKKGKTPYEAYYGTDKWENIISRVSRFNGRDRIKQAKLRRFKMHGEELEEFLDNFTNRQLNDTRYGSKLAKKYLGLLYGGVDNDGIDASRKRRVQATIGAVTAKLRDAMGLNAVLGKGAKSRDDHRHHAVDAVVIALTSPGTIKGISDASQHPALTDVRKIKLAEPWQGFLAEVRQAVDRIVVSHRVDRRVRGPLHEETFYGKPRKDESGKSYVHTRKPLSGISAKDVDSIVDP

SEQ ID NO: 515 - protein, 889 aa, unidentified
  REGION 1..889: note = Description of Unknown: uncultivated organism with predicted taxonomy: Planctomycetes bacterium
  REGION 1..889: note = MG4-97 effector
MSTTRVLGLDIGTSSVGWALIEGRDPDHVRIIAAGVRVFPMGVDEATLESRNIQRRQARLRRRQIERRARRKTKARHILQSHGFLPPGDPSHADPAWASVLALDPYKVRAEGLHRRLQPYEFGRAIYHICQRRGFKSNRKRPLTKKEKGAVHEDIAGLKREMDAAHAETLGEYLNRLDPRQQRRRGRHTNREWYREEFRQLCERQRDFGLPLSPALQKELEETIFSQRKVWWKRGSIGRCSLEPGKQRAARALPVCQRFRMLQRVNDLQIILPDGTTRQLSDEEREKLLARLDWEENLSFKSIRKLLRLPAEARFNLEEGGETKLPGNSTAYRISRAIGKREWERCSPESKAQILEALMSIEDEDLFKRVALRKQWGLNEEQAERLSEVALEEGRLDLSTKAIRKLLPLMEKQRLSYAEAAWRVYGDRGPAQAYESVPPVEDLRNPTVQRSLAETRRIVNAVIRRYGKPDRIHIELARDLKAPKQIRLRRSRQMRRNEAERKSARKELIEQGLPEPTGRDIEKYRLWKECGKRCPYTGKMISFSDLFGPHPKFDIEHIIPWHRCLLDSFANKTLCEVQENRSRKGNRTPYEAYSGDPDRYEEIKQRVREFTGPFGKAKLRRFRCEDIQKLPESLPLYGGEQLNATAYAARYAARHLALLYPQEERRKRVQVSAGRTTAYLRRAWNLNRLIGLADEKNRADYRHHAVDAVVIALTTPKLTGELSKAAARSVRPGTFQGLTPPPGLTRQLEEILDQMVVSHRVDRRVNGQLHEETFYGRIDNDSVTVVRKPLADLTDRDVAHIVDKKVQRLVREKLSGGAPPSKVFANPANLPAFVSPSGRTMRIRHVRVRVDASPVRIGSGAKTRLVLTGGNHHLEVFRVVEDGREKWRG

SEQ ID NO: 516 - protein, 1034 aa, unidentified
  REGION 1..1034: note = Description of Unknown: uncultivated organism
  REGION 1..1034: note = MG4-98 effector
METAENNSVLLGLDIGPNSIGWSLLQPDNGTSPDVNLISGVHIFEGGLDDLETDGKGKSRNLDRRNARAVRRLLWRRAHRLQKLAVSLQGAGLLPDNSDLENPQQRNALFDKLDKEFKSPYQLRARSLDSKLEPYELGRALYHLGQRRGFLSNRKTPVKDEKELGVVKGGINDLSKKISEAGARTLGEYFANKVIPEGGRVRGHYTSRQMYEDEFELIWNKQKEYYPDLLNDEFKEKIHHHIFYQRPLKSQKHLIGECSLERGRRRAPWALLIAQRFRYLQRLNDLSYFDRDEMRERKIEGDQRKILIELFETKEKVSFGAIRKALKLRGIKFNLELGGEKNLPGNKTTARIIKAIGKTKWFSLSEREKEALVVDLRCIRKEETLKRRGIKAWGLDEEAAEKFGTIQLEDGYCNYSRQALQKLLPLLEKGVPLQTAIKELYPEQFENTGKPMDSLPPILESGLPELRNPVVMRSLTEIRKLVNAIIKRYGKPDIIRIELARELKQSPKQRQETTKRMRRNEKERNDIREQIRNETGIENPTYTDILKVRLAKECNWECPYTGTHISMQQLIGPHPQFDIEHIIPHYRSLDNSFTNLTLCEARENREVKRNRTPYEAYHDTAKWEDIIRRVERFDGPMRNAKLRRFLLQGEELEKFLDGFTNRQLNDTAWASKWAKKYLGLLYGDIKSKGIDSAGKLRVQAVSGRLTSELRRIWGLNNILGDGNTKSRDDHRHHAIDAIVIALSNPAVVKQLAEASKRAVNIGDKLLKDFPQPWEGFHNDVKRVIDGIIASHRVSKRVRGALHQGSNYGKPRKDKNGNQYVHIRKPIDGISKKEVENIVHPTTRKLVMDKLAELGESDPKKAFKEKDNHPRLMTKSGEFPIHRVTVRMNLSATFPVGKNYRTRYVISDRNHHIEIVEKPDGKWDGYVVSMFEAYQRKKNGEPIVKREFENDEKFLFSLANGEIIELDGPDNKSRALYVIRTIPQSKQLYFVPINDARKSGDIGRTGLTAIPNALKSRNCKKMLVTKLGEVRFAND

SEQ ID NO: 517 - protein, 1050 aa, unidentified
  REGION 1..1050: note = Description of Unknown: uncultivated organism with predicted taxonomy: Planctomycetes bacterium
  REGION 1..1050: note = MG4-99 effector
WTLLAARQGKPDTPLRPVGLVAAGTRVFDAGVEGDIEKGREKSRAVQRREARLARRGTDRRARRMHLVYSILERAGLLPSLDPPSNSSEGNSRGIREQESQLRHETLVTLDRELAEKWREKLRSEGADKDKLRQINHTIPYILRARALDEKLEPYEVGRAIYHLAQRRGFLSNRKSPLKKDEDLGKVKGDINKLQEKIEETGSRTLGEYFSKLDPEEERIRQRWTGRKMYEEEFGKIWAVQQKHHPNILTEDLKKQLIGSKRHPAIFYQRPLKSQKHLIGKCELEKDRRRAPMAILDFQRFRMIQMLNDTRVITPMGELREMTAEEREKLLAELDIKGDLTFAKAKKVLGLSREHHFNWEGGIEKRIIGNRTAAKLVEIFGIERWKGFSEEERNRIIEDVLSIQKEDTLFRRGINAWGLDEESAKKFSELQLKPDYARFSRRALKKLLPLMQQGIPYKTAEKQVYGDRLAADAHASLPAVADVLPELRNPIVNRTLNELRKVVNAVIRKYGKPALIRIELARDLRNSAKQRKNIMKKIEDNRKAREKAAEGILKEMPHFGEPKRADREKWLLADECNWECPYTGRQISVSALFGENPQFDVEHIIPFSRSLDDSFLNKTICEIAENRNVKRNYTPYEAYGRDEEKWNQILHRVKNFRGRAGNLKLERFQVKEAKFEDFASQQLNDTRYASKLAKKYLGLLYGKDAAKHVQAGRGGVTKFIRDELCLNAILGDGGDEKKRTDHRHHAVDAIAIALTSPGVVKMLSDAARYNEEKGLRRRFGNIKSPWPGFFEDVRKAVENIVASHRVSRRVNGPLHEETNYSPIKKDENGRDCVHIRKPVESLDKKNLKDIVDPVVRERVREWMEQANEHRPYPVHKTKDGREIPIKKVRIRKYDKPMTIGRDHRSRNVLSGSNHHLDIFEVTDKKGRPKWEGRLVSAFEAMQLKRQGKSVYSRERKEGGKFLFSLSQGEIIELDEKDGNRGLYRVRILSQLNQRGIKYPRVSYVRINDARLKADILKAKEWNTKLLEPLRKLNCRKVTITPLGEVRRAND

SEQ ID NO: 518 - protein, 1050 aa, unidentified; identical to SEQ ID NO: 517
  REGION 1..1050: note = Description of Unknown: uncultivated organism with predicted taxonomy: Planctomycetes bacterium
  REGION 1..1050: note = MG4-100 effector

SEQ ID NO: 519 - protein, 1034 aa, unidentified; identical to SEQ ID NO: 516
  REGION 1..1034: note = Description of Unknown: uncultivated organism
  REGION 1..1034: note = MG4-101 effector

SEQ ID NO: 520 - protein, 1056 aa, unidentified
  REGION 1..1056: note = Description of Unknown: uncultivated organism
  REGION 1..1056: note = MG4-102 effector
VFKDDMILGIDIGSNSVGWALLGYDADSREVTGITDAGVRIFEAGMDGDISTGNATSRCAERRAKRLIRRNLDRRRRRMLKLQHILQRAGLLPEGDDIEKIILDLDAEVRKFCLAVPEGERPSREVLAHTYPYFLRALAINGKLPPHLLGRAVYHLAQRRGFWSNRKSLVDEKELGQVKQGISELRGKMEETGARTLGEYFAYRDPTRDRIRGLWTSRDMYRHEFDLIMNNHPHLVTPDLRKSIEKAIFFQRKLKSVKSLIGHCALEKNKRRCPWYRFEAQEFRILQTITNLKVIEPDGELRELSAEEWENLYRVMMGETGDLDRHGNIKISKAKKLLGLPKGSKFTIEDGGEKTLKGNKTLSSLLAVFGDSWNEFSPRDKEDILHDLRSFEKREPLVRKAMRKWNLEQEEAEAFADIKLPEDYCNLSYKALCKLLPLLREGWSYGSAVKEIYPEAFKSDGIVHELLPGLDTSSIDLRNPVVERSLTELRRVVNAVIRKYGKPGIIRLEMAREMKLSANRKKEIIKRNRDLEKQREKAAEKIRDVFPGMTPGRTDTTKVLLAEECGWRCPYTGRSISIRTLFGPHPQFDIEHIIPRSRSLDDSFLNKTLCYHEENRNVKRNRTPYEAYHGTPRYDEILDRVAKFNGRLAKEKLRRFRMTPEEVEDRFADFTQRQLNDTRYAAKEAAAYLGMLYGGSVTSIDGRKRVQVLSGGLTYKVRSAYNLNGILNDGDVKTRNDHRHHAVDAIAIGMTSPGMVKKLTEIAKELENRRDYIRFGTGKGILPDKWNTFDEDVRRVIGKIKVSHKIPRKVRGAFHEETFYSKEYEHKVNGKTGMYRHVRIPLENLEKNKIPKVVDKGVREAIIRKLDELGIDDPRRAFRNGENLPEIVSADGAKRIPIKKVKIIRKQNTIRVGEGRRARNVVPGNNHHMMIYAVLDKRGEVKKWDGEVVTLLEARRRLMNGEPLVNKVNTPTARYVMTVQRGDVFEMDIKGKRELVITRDVPQTKQMSFVRLNDARLKKEIKSSGEWFTKRPNSMRTSNVKKFTITPLGELRNSNA

SEQ ID NO: 521 - protein, 1056 aa, unidentified; identical to SEQ ID NO: 520
  REGION 1..1056: note = Description of Unknown: uncultivated organism
  REGION 1..1056: note = MG4-103 effector

SEQ ID NO: 522 - protein, 867 aa, unidentified
  REGION 1..867: note = Description of Unknown: uncultivated organism with predicted taxonomy: Planctomycetes bacterium
  REGION 1..867: note = MG4-104 effector
LYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTT

SEQ ID NO: 523 - protein, 1021 aa, unidentified
  REGION 1..1021: note = Description of Unknown: uncultivated organism
  REGION 1..1021: note = MG4-105 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLAPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWAKDGQEYLCVIRGISLPQFSCMPINDARDVKTLKAAGLWFTPTLSAAFRGKMEKFHTTPLGELRRAND

SEQ ID NO: 524 - protein, 1022 aa, unidentified
  REGION 1..1022: note = Description of Unknown: uncultivated organism
  REGION 1..1022: note = MG4-106 effector
MKQRVLGLDLGISSVGWAVIDDDNTNRIELIDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 525 - protein, 992 aa, unidentified
  REGION 1..992: note = Description of Unknown: uncultivated organism
  REGION 1..992: note = MG4-107 effector
IDWGSRIFEPGVDATEDEIRAGKGESRCSVRRQKRSLRRMYQRRRRHKEEVTAILMREGMLPEKLTPEFFVKVDRDFLLTLPENERKRAAHVVPYLLRSLALDRPLDRYQLGRALYQLAQRRGYKSNRKQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERKMLLWCLDGLSGHLNSKGRIALSKLGKLVGLDKGEKFTLGDDDKDICGNELNAILFRAFGDKAVELSEAERNIFLNTLNSVENNAVMRKILMEKWHFNEETAEELSHIVLPDDYCNYSRKAIENLLPDMEAGIALNTIIKLKYPEQYQPSDVVEPVLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYVEIIERVRHFKGSFAKIKLEKFELETAEVQDFINRNLNDTRYASKLATEYLALLYGGMNDRNRVQRIQCSAGGCTAVVRRAWGGNYLLGEGEKVRGDHRHHAIDALTIAVTSPAIVKLIAGLKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 526 - protein, 1021 aa, unidentified
  REGION 1..1021: note = Description of Unknown: uncultivated organism
  REGION 1..1021: note = MG4-108 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKALKAAGLWFTPTLSAAFRGKMEKFHTTPLGELRRAND

SEQ ID NO: 527 - protein, 883 aa, unidentified
  REGION 1..883: note = Description of Unknown: uncultivated organism with predicted taxonomy: Planctomycetes bacterium
  REGION 1..883: note = MG4-109 effector
MQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEVFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 528 - protein, 1021 aa, unidentified
  REGION 1..1021: note = Description of Unknown: uncultivated organism
  REGION 1..1021: note = MG4-110 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGSSRKALKQLLPDLESGIALSTVIKLKYPEQFQASERVLEFLPPLDETGLQLRNPVVHRTLTEMRQVVNAVIRKYGKPDLIRLELARDLKNSSKDRENIARRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKLQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 529 - protein, 879 aa, unidentified
  REGION 1..879: note = Description of Unknown: uncultivated organism with predicted taxonomy: Planctomycetes bacterium
  REGION 1..879: note = MG4-111 effector
KEEVTAILMREGMLPEKLTPEFFVKVDRDFLLTLPENERKRAAHVVPYLLRSLALDRPLDRYQLGRALYQLAQRRGYKSNRRQEAKDSESGKVLSGIADLKQAMADSGARTLGEYFSMLDPEESRIRTRYTERGMFEDEFHKICVAQRHIISVEVEAELHHAIFFQRKLRSCKHLIGNCRLEPDKKRCSYSTMAAQRFRLVQGVNNLKVSNKSGVIRELTEDERENALVVLDGLSGHLNSKGRIALSKLGKLVGLDKGEKFTLGDDDKDICGNELNAILFRAFGDKAVELSEAERNIFLNTLNSVENNAVMRKILMEKWHFSEETAEELSHIVLPDDYCNYSRKAIENLLPDMEAGIALNTIIKLKYPEQYQSSDVVEPDLPRLEEVDLDIRNPIVQRTLSELRRVVNAVIRKYGKPDLIRVELARDLKNSSKDRENISRKNSEREKERKKIAEKIAREAGIENPSPRDILKVMLAEECDYTCPYTGKSFSLNQLLHGGEIHIEHIVPYSRSMDDSYANKTLSYRDANMAKSDKLPFEAFDSAKYAEIIERVRHFKGSFAKIKLEKFELETAEVQDFINRNLNDTRYASKLATEYLALLYGGRNDRNGVQRIQCSAGGCTAVVRRAWGGNYLLGEGEKVRGDHRHHAIDALTIAVTSPAIVKLIAGVKGEDRRRAIEEKRPLVVTDLYTQAKAKLDSAGISHHTVNKLRGALHKETIYSKSYGGDVRHARKALEDLEADKVKDIVDDAIRKAVEEKLDDLGIADPKKAFKGGTNLPVLRDRNGNIVNIIKRVRVLQTQSTRTIGSGDGQREVANGANHVLAIYSVLDKDGNEIGWDGEIVSLMDARLRMLKGEAVYPLEKNGNPLKFTLRKGDIVRWTK

SEQ ID NO: 530 - protein, 1021 aa, unidentified; identical to SEQ ID NO: 526
  REGION 1..1021: note = Description of Unknown: uncultivated organism
  REGION 1..1021: note = MG4-112 effector

SEQ ID NO: 531 - protein, 992 aa, unidentified; identical to SEQ ID NO: 525
  REGION 1..992: note = Description of Unknown: uncultivated organism
  REGION 1..992: note = MG4-113 effector

SEQ ID NO: 532 - protein, 1021 aa, unidentified
  REGION 1..1021: note = Description of Unknown: uncultivated organism
  REGION 1..1021: note = MG4-114 effector
MKQRILGLDLGINSVGWAIVDDDNDAQVDLLDWGSRIFAPGLAATTEEIVSGKGESRCAERRLKRAQRIAYRRRRQHKDELTRVLSGSGLLPEQVSPEFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMKEEERQAFFHHLACMEKDDALRRILRTRWGLSEEAAEKAAHISLPDDYCGFSRKALKQLLPDLESGIALSTVIKLKYPEQFQASERVLEFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKTRSIGEGDRKREVANGANLVLAIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 533 - protein, 1015 aa, unidentified
  REGION 1..1015: note = Description of Unknown: uncultivated organism
  REGION 1..1015: note = MG4-115 effector
GLDLGINSVGWAIVDDDNDAQVDLLDWGSRIFAPGLAATTEEIVSGKGESRCAERRLKRAQRIAYRRRRQHKDELTRVLSGSGLLPEQVSPDFFLQIDRAFLAGLPEDEQKRAAHVVPYLLRAAALDRPLEPMQLGRALYHLGQRRGYKSNRKQEAKDSEAGVVLSQIAELKEAIRNSGARTLGEYFSTLDPEQRRIRTRYTERGMFEEEFRKICAAQRPLISEALERALYHAIFFQRKLKSCKHLIGFCRLEPEERRCSFQDPLAQRFRILQEVNHLRVDGRGVLRPLTEEERQKVLTVLDGLSGELNAQGTIALSALGRLAGLRRGEKFTLGDEDKKVYGNELHAILFRVFGARAAAMNEEERQAFFHHLACMEKDDALRRILRTRWGLSEEAAEKAAHISLPDDYCGFSCKALKQLLPDLESGIALSTVIKLKYPEQFQASERVLAFLPPLDETGLQLRNPVVHRTLTEMRQVVNAVIRKYGKPDLIRLELARDLKNSSKDRENITRRNRLREKERERIAREIAQEAGVEKPSRRDILKVMLAEECDYTCPYTGRRFSMRDLLHGGLVHIEHIVPYSRSMDDSFINKTLSCRDANAEKGNRLPFEAFSPEAYREILERVRRFKGPFAEAKLERFKMQKAESRDFIERNLNDTRYASKLATEYLALLYGGRWDRNGVLRLQCSAGGCTAVVRRAWGGNYLLGEGEKERGDFRHHAIDALTVAVVSPAIVKAVAEMPKETVRKAIEEKQPLIVNSLYTQARAKLDAAGISHHTINRARGAFHKETIYSKSHGGDLRHVRRRLDTLEPKTVAEIVDVAIRRAVEEKLAELKMTDPRKAFKDGGNLPVLRDRQGRFVNTIRSVRVRQNVKIRSIGEGDRKREVANGANLVLAIYARHDADGREIGWDGEVVTVLDARLRLQRNEPVFPKVKEGNPLKFTLRKGDVVRWSKDGQENLCVIRGISLPQFSCMPINDARDVKTLKAAGLWFTPTLSAAFRGKMEKFHTTPLGELRRAND

SEQ ID NO: 534 - protein, 1071 aa, unidentified
  REGION 1..1071: note = Description of Unknown: uncultivated organism
  REGION 1..1071: note = MG4-116 effector
MAHGLSEENDYILGIDLGSASLGWALVALSESGDPTGIIKLGVRIFEPAVSGDVEKGQDESNSVARRGARLIRRQRRRRAARQAALFRLLQKQNLLPGTTGVERDSSAQRHVILNELDSALSLKWRQRDSENGFVDLPIYHLRKAALYHALDPFELGRVFYHLSQRRGFRSNRKAERIEKKGEDQGAVKTAISELDEAIRAAGAQTIGEYFAGLDPHTQKVRRIWTGRSMYEEEFGKIWAIQSRFHPTLLTEELHREIWRLLFYQRPIKAQKNLIGECELEPGERRASWATLEAQRFRLLQKVNDLEIIYPGKLMGVALSADQRQHVYRLLDEHGDQTFKAIREHLGLDKNIGFNLERGGERSLKGNIVQRRMIEAFGPRWQALADEEKRQVVDDWRSIESPESLQRKLIAKWRLVPEAASRLAKSSPPSGYCMLSRKAIRRVLPLMFDGKRFMAARQEIPEYVPKLEAPLDRIPPVLDALRNLRNPAVERALTEVRKVVNALVGEYGKPSEVRIELARDLKKPRQERARATDLNRKRQRERDSVKERIVREGGLERPSRDDIEKVLLWEECGGICPYTGKSIAFASLFGEHPQFGVEHIIPFSRLPDNSFQNKTLCDHEQGRNVKRNKTPFEAYPNTEEYDAILTRIKAWETPNLGKQKRFELRTLEELEGFSTRQLNDTRYSSRLACDLIAKLYGGRVIETETGTRQVVFASSGMVTATLRKGLGLEAVLCEASGSSNGETRGKSRTDHRHHAIDALTIALTRQSMIQTMSRTASLEPNWAITSRSLRTIPSPWSNFIDSVRPHVQELLVSHRPEHRLTGALHDETNYSKPRKVNGKSVVHIRKPVNGLSANDIENIVDPVIRDAVRRKAIDLGGDLKRCNPNAGVDDWPQLVTKTGKHVPIKRVRISKSLEVETIATGNRTRYVATSSNHHLAIFAQIDSQGREKHWEPRIVSLYAAMDRKRKGLPVVQRFHPETGDFTFKFSLMGGDTVLLHKDCDHSKGICNASVWRLRTIASNGQLSLVRINDARLKADIQKAKEWWSPATDSLRKFSAIKVSIDSLGRLHGAND

SEQ ID NO: 535 - protein, 1062 aa, unidentified
  REGION 1..1062: note = Description of Unknown: uncultivated organism with predicted taxonomy: Acidobacteriales bacterium 59-55
  REGION 1..1062: note = MG4-117 effector
MSAALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 536 - protein, 1071 aa, unidentified; identical to SEQ ID NO: 534
  REGION 1..1071: note = Description of Unknown: uncultivated organism
  REGION 1..1071: note = MG4-118 effector

SEQ ID NO: 537 - protein, 1062 aa, unidentified
  REGION 1..1062: note = Description of Unknown: uncultivated organism
  REGION 1..1062: note = MG4-119 effector
MSSALEQQKYVLGLDLGSASLGWALIALNDADDPVSLIRAGVRIFEPGVDGTSIEIEQGKDQSKAVERRTARLHRRQLRRRAARQRDLFRLLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKVAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEVAFLFSLMKDDTVELEKDGTRGIYRVKKFEATGKITFVPVNNAMLDKMQYTTGAAWSRMPATLKPMSPRKIVIDLLGKVHPAND

SEQ ID NO: 538 - protein, 1071 aa, unidentified; identical to SEQ ID NO: 534
  REGION 1..1071: note = Description of Unknown: uncultivated organism
  REGION 1..1071: note = MG4-120 effector

SEQ ID NO: 539 - protein, 972 aa, unidentified
  REGION 1..972: note = Description of Unknown: uncultivated organism with predicted taxonomy: Acidobacteriales bacterium 59-55
  REGION 1..972: note = MG4-121 effector
LLQRHSLLPTPEGVIGSPEEQRHLILNSLDQQLTDKWQSAFPINRFAELPIYFLRKAALDQPLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMSRFAIQTEEALGDFSARQMNDTRYASVLASRFLGALYGGRDLVDAEKVRQVIFASSGAVTATLRSSWGLEAILREIVPTEPGEPRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRNGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 540 - protein, 853 aa, unidentified
  REGION 1..853: note = Description of Unknown: uncultivated organism with predicted taxonomy: uncultured bacterium
  REGION 1..853: note = MG4-122 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALS

SEQ ID NO: 541 - protein, 1071 aa, unidentified; identical to SEQ ID NO: 534
  REGION 1..1071: note = Description of Unknown: uncultivated organism
  REGION 1..1071: note = MG4-123 effector

SEQ ID NO: 542 - protein, 1071 aa, unidentified; identical to SEQ ID NO: 534
  REGION 1..1071: note = Description of Unknown: uncultivated organism
  REGION 1..1071: note = MG4-124 effector

SEQ ID NO: 543 - protein, 1071 aa, unidentified; identical to SEQ ID NO: 534
  REGION 1..1071: note = Description of Unknown: uncultivated organism
  REGION 1..1071: note = MG4-125 effector

SEQ ID NO: 544 - protein, 1079 aa, unidentified
  REGION 1..1079: note = Description of Unknown: uncultivated organism
  REGION 1..1079: note = MG4-126 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 545 - protein, 1076 aa, unidentified
  REGION 1..1076: note = Description of Unknown: uncultivated organism
  REGION 1..1076: note = MG4-127 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPGTLDGSPEEQRHSILNELDQALARKWQSAFPDNRFAQLPLYYLRKRALDEPLEAYEIGRILFHLIQRRGFLSNRRENKQNPDQKKELGQVKAEIHSLEQEIQNAGARTLGEFFAGLDPHAQKVRRRWTARKMFQDEFEKIWETQVIHCPNLLTPELHDKIAHLLFFQRPIAAQSHLVGKCELESGKQRAPWAAMEAQRFRILQKVNDLRLVNPGSLISDPLTEEDRQRLYSLLDREGDQTFKAIKKYLSFPTDVQFNLEKGDEKRLRGNRTQAAMRKVFADRWDTMSAGKQHQIVENWRNSESDEALIREAEEQWSLDDTAATLLSEQIPEPGYCAVSLTAISKLLPLMQCGKSFKEAETEVYGARFSGGVVFDTLPEVRKQLESLRNPAVERALTELRKVVNAIVREYGKPYEIRIELARELKKPRQERLEATKKNRTRQREREDIAGRILRECGLSNPSRKDIEKARLHEECGGICPYTGRPIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTASLRSSWGLEAILHEIVPAESGESRGKPRTDHRHHAIDAITIALTRPKVIQSMARTASLEPWQIDSRAWRKIELPWRDFVPSIRPHIEQMLVSHRPEHKMSGELHKGTNYSAPYNYKGKPTVHTRCLLSALSAAKIADDEVIIDTAVRDAVRKKLAELGGNPKLFDRPENAPCLCARDGRLIPIRKVRIRETKNPVKVGKGVRERFTSSGGIHHVALFVTRDEKRREKWDSEVAQVTEIYRRCPRNDRRKSRSQPVVIESPISRQLKSDPEAQFLFSVMKDDTIEVTDPNGIYILRVKKFSDNKQMWFVPVNDAHDDTQQMKLGITWSKTPNSLKELRPRKVVVDLLGKVHPAND

SEQ ID NO: 546 - protein, 1062 aa, unidentified
  REGION 1..1062: note = Description of Unknown: uncultivated organism with predicted taxonomy: Acidobacteriales bacterium 59-55
  REGION 1..1062: note = MG4-128 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 547 - protein, 973 aa, unidentified
  REGION 1..973: note = Description of Unknown: uncultivated organism
  REGION 1..973: note = MG4-129 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRD

SEQ ID NO: 548 - protein, 951 aa, unidentified
  REGION 1..951: note = Description of Unknown: uncultivated organism with predicted taxonomy: Planctomycetes
  REGION 1..951: note = MG4-130 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSNRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMELFATL

SEQ ID NO: 549 - protein, 1062 aa, unidentified
  REGION 1..1062: note = Description of Unknown: uncultivated organism
  REGION 1..1062: note = MG4-131 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 550 - protein, 835 aa, unidentified
  REGION 1..835: note = Description of Unknown: uncultivated organism with predicted taxonomy: Planctomycetes bacterium
  REGION 1..835: note = MG4-132 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNCEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQ

SEQ ID NO: 551 - protein, 785 aa, unidentified
  REGION 1..785: note = Description of Unknown: uncultivated organism
  REGION 1..785: note = MG4-133 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNA

SEQ ID NO: 552 - protein, 1062 aa, unidentified
  REGION 1..1062: note = Description of Unknown: uncultivated organism with predicted taxonomy: Acidobacteriales bacterium 59-55
  REGION 1..1062: note = MG4-134 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 553 - protein, 1062 aa, unidentified; identical to SEQ ID NO: 549
  REGION 1..1062: note = Description of Unknown: uncultivated organism with predicted taxonomy: Acidobacteriales bacterium 59-55
  REGION 1..1062: note = MG4-135 effector

SEQ ID NO: 554 - protein, 1062 aa, unidentified; identical to SEQ ID NO: 549
  REGION 1..1062: note = Description of Unknown: uncultivated organism with predicted taxonomy: Acidobacteriales bacterium 59-55
  REGION 1..1062: note = MG4-136 effector

SEQ ID NO: 555 - protein, 1105 aa, unidentified
  REGION 1..1105: note = Description of Unknown: uncultivated organism with predicted taxonomy: Acidobacteriales bacterium 59-55
  REGION 1..1105: note = MG4-137 effector
MSVSAGSEHPYVLGLDLGSASLGWALIGIDAIETPVSLIRAGVRIFEPGVDGSALDIQQGKDQSKAVDRREARLHRRQLRRRVARQRELFGVLQGAGLLPTCDVPGAGIGSEQRHRILNALDMALTVRYRTGADKATFDQMPLYVLRKKALYEPLAFDELGRVFFHLSQRRGFQSNRKDVKKKTKEDEDQGQVKSAIYELEQAIQASDAQTLGEYLAGLDPHEQKVRRQWTGRRMFKEEFERIWVAQQAYHPSLLTPELHDRVWGLLFDQRPVSAQKHLVGKCELEPDKRRSPWAALPAQQFRVLQKVNDLRLLQENGKETPLYPQQRAAVFDLLENHGTQSFVKIKQHLGLPKTAQFNLERGKAKELKGNVTAQSMRKVFGVRWEEFSEGKQNQIIENWRNSEKDEDLKREAIEHWGLDEASANVLLAEKAPADYCALSLTALSKILPLMRAGKSFKEAETEVYDNRFSGAAVHPFIPVLRPHRKHFHNSTPPPQDPLMASIANGLRNPAVERAITEMRKVVNAIVREHGRPYEIRIELARELKKPRSKRLDETANNRKREAENRALAKRMHEECGIPQPPSRKDLEKAKLWVEQATGAGVCECPYTGKKLPFSRLFDDDNGFDVDHILPRSRHPDDSFQNKVLCWGEENRMHKRNQTPYEAYAEQDQERWQEILARVTRWKNPGKLRKFEIRSTDELEAFSSRQLNDTRYTSLLAARLLSTLYGGRDVTENGKNRQVIFASTGAVTATLRRNWGFEQILRGIIPAEPGESSGKPRTDHRHHAIDAIVIALTRNNVIQAMARASALEAWQSGTRSWRHVPQPWRTPDFFRSVEQQVAEVLTSHRPEHKVGGELHRGSNYGRPYMYNGASTIHTRKLISALKIEDIDADDVIVDRVIRDILRAKLAELGGNPKAFEKPENTPYMTTPAGKRIPIRKVRIRETRNPLRVGEGPRERYVASGGIQHVELFVARDEKRREHWLSHVVQTTEMYDLFPKRDHRPGRPKAVTKSIPIRRQMPGQPEAEFLFSLLKNDTIELEKAGCREIFRVKKFEATGKITFVPINNAMPDTLQYGTGSAWSKMPTTLKVMSPQKVVIDLLGRVHPAND

SEQ ID NO: 556 - protein, 1001 aa, unidentified
  REGION 1..1001: note = Description of Unknown: uncultivated organism with predicted taxonomy: uncultured bacterium
  REGION 1..1001: note = MG4-138 effector
DESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAIDAITIALSRPKMIAALSRNNAQDPYWPNNGRTTPKIQSPWKDFVDSIRPHFEQMLVSHRPEHRLTGALHDETNYGRPRKEGGKDVVHIRKPLVGKNKGEGLSSEDIENIVDPAVREAVKEKAVQFGGSLKTWTPNAAQDDWPLLKTKTGKQIPIKRVRIRKAIKVFPVGETAYRTRHVAPGADSIHHIAVYVTKDKHGRDKWISEIVRIFEEKQRWQAWKKKGGAVVPLVYSTHSEDKDAEFLFYLMKKDTLELEVNGKRAVYLVTSFESDGRINLIPINSSGKREDQKDSKIV

SEQ ID NO: 557 - protein, 1067 aa, unidentified
  REGION 1..1067: note = Description of Unknown: uncultivated organism
  REGION 1..1067: note = MG4-139 effector
MTESGSSQSNYVLGIDLGTTYAGWAAISLNQSGKPTGVLRAGVRVFDTTVTGNVEKGQDESNAIARRNARLVRRQLRRHVARQKALFQLLQQHGLLPPYQGTESDSSRQRHQILNALDHELVIKRASTGDANAKAAVELPLYLLRKIALDAALEPFELGRVFYHLSQRRGYKSNRKEKPTDKKKVAELGVVESGIEDLTEEMHRAHARTLGEYFASLDPHAQKIRGRWTARKMYEEEFALIWEKQATFRPDLLTEELHHQVKHLLFYQRPLKAQSHLIGRCELEPGERRAAWATLEAQEFRLLQEVNNLEIILPGSVIGVPLTAQQRQTVLDLLENSAEVTFKQIRKALGLANNAGFNLQHGGETRLKGNATNAYMNEVFGERWSAMPDGDKKQVVEDWRTIEQEDSLVRRAVSHWHLDEANAQWLASRSAPNGYCAFSRKAISKMLPFLAAGKSGQEAEIKIYGSRLSGGKVYDRIPPVRDFLKNLRNPAVERSLTELRKVVNALVQEYGKPVEIRIQLARELKKSRRERMESVSTNRDREKQRNAAKEKLLKELGLQHPSRADIEKALLWEECQGVCPYTGKQFPFSSLFGENPSMQVQHIIPFSRIPDDSFQNKTLCSVEENQYKANRTPFEAYADPAQYEAILDRVKNWPRPNRGKQRRFELRTLEELEGFSSRQLNCIRYASQMACKLMGTLYGGRDMETAGRSRQIIFASTGMLTGTLRRAWGLEAILREETPSSIEGKPRNDYRHHAIDAIAVALSHPKLIAALSRSDDSYAWATRALLKIESPWKNFIDSIRPHFDQMLISHRPEHRLTGEIHKATNYSMPHEEDGKQVVHLRRPVPGLTMKDIENIVDPATREAVRAKAVEYGNELVKWTPNQGGTDWPQLVNKSGKHIPIKKVRVKEVLNVRAIGKGESTRYVALKNNHHVAIFALLNEVADEKRWVPVVVSLFDAMQRKNKSEAVIQTTYSGSGKAAFKFSLMGGDTLLLHKDCDHGNSKCNPSVWQVRTIAASGQLSLVRINDARQKADILKAKEWWSPSVETLRKLEAIKVTIDSLGGIHQAGG

SEQ ID NO: 558 - protein, 1114 aa, unidentified
  REGION 1..1114: note = Description of Unknown: uncultivated organism with predicted taxonomy: Planctomycetes bacterium
  REGION 1..1114: note = MG4-140 effector
FQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRRIVVSRRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 559 - protein, 1079 aa, unidentified; identical to SEQ ID NO: 544
  REGION 1..1079: note = Description of Unknown: uncultivated organism
  REGION 1..1079: note = MG4-141 effector

SEQ ID NO: 560 - protein, 764 aa, unidentified
  REGION 1..764: note = Description of Unknown: uncultivated organism with predicted taxonomy: Polaribacter sp. ALD11
  REGION 1..764: note = MG4-142 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGEYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEP

SEQ ID NO: 561 - protein, 1062 aa, unidentified
  REGION 1..1062: note = Description of Unknown: uncultivated organism
  REGION 1..1062: note = MG4-143 effector
MSSALEQQKYVLGLDLGSASLGWALIALNGADDPVSLIRAGVRIFEPGVDGTSIEIEQGKDQSKAVERRTARLHRRQLRRRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 562 - protein, 1076 aa, unidentified; identical to SEQ ID NO: 545
  REGION 1..1076: note = Description of Unknown: uncultivated organism
  REGION 1..1076: note = MG4-144 effector

SEQ ID NO: 563 - protein, 752 aa, unidentified
  REGION 1..752: note = Description of Unknown: uncultivated organism
  REGION 1..752: note = MG4-145 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNH

SEQ ID NO: 564 - protein, 1035 aa, unidentified
  REGION 1..1035: note = Description of Unknown: uncultivated organism with predicted taxonomy: Acidobacteriales bacterium 59-55
  REGION 1..1035: note = MG4-146 effector
LNGADDPVSLIRAGVRIFEPGVDGTSMEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 565 - protein, 1079 aa, unidentified; identical to SEQ ID NO: 544
  REGION 1..1079: note = Description of Unknown: uncultivated organism
  REGION 1..1079: note = MG4-147 effector

SEQ ID NO: 566 - protein, 1062 aa, unidentified; identical to SEQ ID NO: 549
  REGION 1..1062: note = Description of Unknown: uncultivated organism
  REGION 1..1062: note = MG4-148 effector

SEQ ID NO: 567 - protein, 1062 aa, unidentified
  REGION 1..1062: note = Description of Unknown: uncultivated organism
  REGION 1..1062: note = MG4-149 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLISEAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 568 - protein, 901 aa, unidentified
  REGION 1..901: note = Description of Unknown: uncultivated organism with predicted taxonomy: Polaribacter sp. ALD11
  REGION 1..901: note = MG4-150 effector
SASLGWALIALDESDNPVSLIRAGVRIFEPGVDGAKPGTPASAQEIQFGKDQSTAVARRQERLRRRQLRRRVARQRKLFGVLQGAGLLPTGDVLGAGIGSEQRHRVLNNLDADLMNRYRSSADKANFGQMPLYALRKKALYEPLALDELGRVFFHLSQRRGFQSNRKDVQKKTKGSEDQGQVKSAIHELEQAIQVAGAQTLGEYLAGLDPHEQKVRRQWTGRKMFEKEFQMIWDKQKEYHTDLLTSELHGRIWDLLFFQRPVAAQKHLVGKCELEPDKRRAPWAALLAQQFRLLQKVNDLRLIEEDGNELPLNEDGRIAVFNLLENHGTQTFAKIKQHLGLPKTAEFNLERGKAKELKGNITAQSMRKVFGERWTQFSAGKQNQIVENWRNSEKDEELRREAMEHWGLDEAGANALVNEKAPGDYCSLSLMALGKILPLMRAGKSFKEAETEIYGNRFSGAAVHSLIPVLRPNRKHFRNSTPPPQDPLMASIANGLRNPAVERSITEMRKVVNAIVREYGKPCEIRIELARELKKPRSKRLDETARNRKREAENKALAERMHNECGMPQNSSRNDLEKAKLWVEQQGQCPYTGRSLPFSRLFDDNNGFDVDHILPRSRHPDDSYQNKVLCWGDTNRMVKRNQTPYEAFAEQDPENWHQILARVARWKNPGKSRKFEIRSTDELAEFSSRQLNDTRYTSLLAARLLSTLYGGRDLAENGRKRQIIFASSGAVTATLRRNWGFEQILRNIIPPEPNESSGKPRTDHRHHAIDAIVIALTRNDVIQAMARASALEPWQPGTRSWRHVPQPWHTPNFFRSVEEQVREMLTSHRPEHKVSGELHKGSNYGRPYLYNGKPTVHSRVSISALRSQDIEDDDVIVDRRVRDILRTKLAEIGGNPKAFEK

SEQ ID NO: 569 - protein, 1105 aa, unidentified; identical to SEQ ID NO: 555
  REGION 1..1105: note = Description of Unknown: uncultivated organism with predicted taxonomy: Acidobacteriales
  REGION 1..1105: note = MG4-151 effector

SEQ ID NO: 570 - protein, 1079 aa, unidentified; identical to SEQ ID NO: 544
  REGION 1..1079: note = Description of Unknown: uncultivated organism
  REGION 1..1079: note = MG4-152 effector

SEQ ID NO: 571 - protein, 1062 aa, unidentified; identical to SEQ ID NO: 549
  REGION 1..1062: note = Description of Unknown: uncultivated organism
  REGION 1..1062: note = MG4-153 effector

SEQ ID NO: 572 - protein, 1076 aa, unidentified
  REGION 1..1076: note = Description of Unknown: uncultivated organism with predicted taxonomy: Acidobacteriales bacterium 59-55
  REGION 1..1076: note = MG4-154 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWALDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 573 - protein, 1026 aa, unidentified
  REGION 1..1026: note = Description of Unknown: uncultivated organism with predicted taxonomy: Deltaproteobacteria
  REGION 1..1026: note = MG4-155 effector
MEIQVAVPYVLGIDLGANSVGWAALLHEHGESVGILDLGVRIFAAGVTGLEAGRDESHAAARRVARLQRRQTDRRRRRIHKIYGILADYGLLPAKATPADRAKALSALDNELSARYGAHDNLPYVLRARALGEALSPFELGRALFHLAQRRGFLSNRKSTKEPDDEKGKVKSGITILAHAIAESGSRTLGEHLSRLDPHEARIRGRYTSRQMYLDEFDKIWESQAANHPELLNPERKRELLQAMFHQRPLRDQSDLIGDCELEEGEKRAPAWHPLAQRFRLLQEVNHLRLIDPAGVSRALSAEERQAVVPLLEKGDLPIRELRKLLEIKRNVEINLDRGGKKALIGDRTEEKMRGAFGAAWDALSQEEKLEAITDLAGDLGDTQLARKAQDRWGLSAEQAERYSSTSLEVGRYLGFSLKAIAKMLPLLESGADATTARDAAYPAGTFRTDLLGALPPVAERLKDLRNPAVLRSLTELRKVVNALIGRYGKPLEIHVELARDLKASRPEREDRWARMRRNEKARAEAAAKIQSEIGIHTPGRADTEKWLLAEECHWRCPYSGRGFSATQLYQSGEIQVEHIIPFSRSLDDSFANKTLAYSWVNKAKGNRSPREAFQEQSQWEAILTEVGSFHGPYAKHKLQRFQWTSEQIAELLDDFTKRQLNDTRYASKLAARYMACLYGGLSDSCGQRIFVSPGQVTAFLRRLWAIEGLLSGGGGKSRDDHRHHAIDAVVVALTGPAWVKALSDAASRAREEGRRRFASLEAPWPGFAAAVQDRLQGLTVSHRANLKVGGAMHDETFYGVIQHPELGPTAVCRKLVHRLSKEDLEHIVDPRVRERVALQLGLQGGDFKQLEAHPPTIPTHDGREVPIRKVRIMKAEHTRRIGQGARARNVMGDDYHHLEVIRQTDPRTGKTKWALAAVTCQQAMERVRDHKPLVSRDHGPHAEFVCSVAKDDTLEINEAGNKRLVVVKALEAGRNVVGFKDLRDARPYSATTKNRERVAVARLMDALKCRKVTVSPLGETHYAND

SEQ ID NO: 574 - protein, 1037 aa, unidentified
  REGION 1..1037: note = Description of Unknown: uncultivated organism with predicted taxonomy: Planctomycetes bacterium
  REGION 1..1037: note = MG4-156 effector
SMLGVDLGSAALGWAVVGVADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFARHTLAAEMASQKKRGG

SEQ ID NO: 575 - protein, 1062 aa, unidentified
  REGION 1..1062: note = Description of Unknown: uncultivated organism
  REGION 1..1062: note = MG4-157 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 576 - protein, 1062 aa, unidentified; identical to SEQ ID NO: 549
  REGION 1..1062: note = Description of Unknown: uncultivated organism
  REGION 1..1062: note = MG4-158 effector

SEQ ID NO: 577 - protein, 1062 aa, unidentified; identical to SEQ ID NO: 549
  REGION 1..1062: note = Description of Unknown: uncultivated organism with predicted taxonomy: Acidobacteriales bacterium 59-55
  REGION 1..1062: note = MG4-159 effector

SEQ ID NO: 578 - protein, 1075 aa, unidentified
  REGION 1..1075: note = Description of Unknown: uncultivated organism with predicted taxonomy: Planctomycetes
  REGION 1..1075: note = MG4-160 effector
MAAAKKPYILGLDLGVQSAGWAMIDVDDHGRPCGIRRSGVRCFDSGVGSETEIASGKDESQNIKRRQMRLQRRQLWRRGRRLKKVFLVLQKAGILPPGETRSPEQRHELLKLLDAELAKTHLPEHDRVAGHLLPYRLRALALDQALPPFAFGRALFHLAQRRGFLSIRKSASKDGDDEGAVKAGIAELQQNMQEAGVRTLGEYFSKLDPEAEKQRIRKRWTARSMYLDEFEKIWVAQSPHHPMLGEEWKTRVYDAIFHQRPLKSQKGLVGVCELEPTCRRAPRASVEAQRFRYLQKVNDLEIVTPDGEIWALTDPEHVDLRKKLIELLDTQAEVKFASLRSKLGLWAKLGRKKPKGTDKDFTFNLEAGGESKLKGNTTATKIRGVLGDDYGKLSPEQLAGLVDDLLEYEKKEALARRLTKNYEIAPAKADQLADVTLEPNYASLSREAMHKLLPIMENGRRFASLTQEELEKLFPNRRKGGITYDLLPPVLGIIDLRNPVVCRGLTELRKVLNALIRQYGKPELIRVELARDLKKSRQQREDLTKQNRDNEKARDAARTKIAERLHCDENAVSNLDILKVRLAEECNWECPYTGKSIAIEALVGKHAQFDIEHIIPFSRSLDNSFLNKTLCDNHFNRHVKKNGTPHETCSSNEREWQEIIGRVKRFRGSAAHAKLRKFQQEKPDEDFAARMLQDTRYMSRLATEYLGLLYGGTIDADHTRRVQVSAGRVTAYLRDEWGLNAILADGGEEEKNRDDHRHHAVDASVIALTNAGTVELLSHSAEVAAERGRRLFVREEIQQPWPTFLDDVRRAIEAINISYRVNRRVTGALHEETNYSKPHKSRDGNGNGKEVEYRHVRKPLQNMSANEVENIVDDIIRKLVQTKLDQIGGEPKKVFADPGNHPYLTAKDGRRIFIHKARIRKTVAVIPLGKSSSPRYAAPGSNHHMEIFATLDQEGKENRWESKIVSLFEAHRRVRAGEPVIQRDHGSNTEFKFSLAGGEYLELDDDGGGRRLVRITVISGKIAEFRLHTDARPITILRQTKGGRAGLSKPVDSLRKANARKVVVDPLGNILPAND

SEQ ID NO: 579 - protein, 780 aa, unidentified
  REGION 1..780: note = Description of Unknown: uncultivated organism with predicted taxonomy: Acidobacteriales bacterium 59-55
  REGION 1..780: note = MG4-161 effector
LETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 580 - protein, 792 aa, unidentified
  REGION 1..792: note = Description of Unknown: uncultivated organism
  REGION 1..792: note = MG4-162 effector
LHYKIKHLLFYQRPIKAQSHLIGDCELEPGERRAAWATLEAQQFRVLQKVNDLEIILPGNVTGIPLTPEQRQTVLNLLESSSEATFKKIRKALGLGENIGFNLQRGGETKLKGNLTNSHMADVFAERWLEMSEEDKKQVVEDWRTIEREESLIRRATEHWKLDETGAKWLASRPAPSGYCSISRKAIRKLLPLMMEGKRFKEAENEIWGSRFSGGQVYDRIPPVRQALKSLRNPAVERALTELRKVVNALIRELGKPTEVRIDLDRDLKKPRHERAKAVSQNRDREKQRSAAKVKMLQEIGPGFEHPSRADVEKALLWEECQGECPYTGKRFPLSSLFGENPPLQVEHIIPFSRIPDDSFQNKTLCYHEENQIKGNRTPFEAYKDAEQFETILNRVRNWRTPNPGKQRRFELRTLEELEGFSSRQLNDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHRLTGALHDETNYGRPHKEGGKDVVHIRKQVVGMSAGDIENIVDPAVRESVREKAASFGGDLKKWTPKEGSEDWPLLRTKTGKEIPIKRVRIKKSLGVETIAKGDRARHVALSSNHHVAIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWS

SEQ ID NO: 581 - protein, 1106 aa, unidentified
  REGION 1..1106: note = Description of Unknown: uncultivated organism with predicted taxonomy: Acidobacteriales bacterium 59-55
  REGION 1..1106: note = MG4-163 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLSQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWRTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 582 - protein, 1015 aa, unidentified
  REGION 1..1015: note = Description of Unknown: uncultivated organism
  REGION 1..1015: note = MG4-164 effector
ARRVARLLRRQLRRRSARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLRSIAANGQLSLVRINDARPKSEIIKAKEWWSPIEDTLRELDAVKVVIDSLGRIHQAGG

SEQ ID NO: 583 - protein, 1062 aa, unidentified; identical to SEQ ID NO: 549
  REGION 1..1062: note = Description of Unknown: uncultivated organism
  REGION 1..1062: note = MG4-165 effector

SEQ ID NO: 584 - protein, 1076 aa, unidentified; identical to SEQ ID NO: 572
  REGION 1..1076: note = Description of Unknown: uncultivated organism with predicted taxonomy: Candidatus Sulfotelmatomonas gaucii
  REGION 1..1076: note = MG4-166 effector

SEQ ID NO: 585 - protein, 1105 aa, unidentified; identical to SEQ ID NO: 555
  REGION 1..1105: note = Description of Unknown: uncultivated organism with predicted taxonomy: Acidobacteriales bacterium 59-55
  REGION 1..1105: note = MG4-167 effector

SEQ ID NO: 586 - protein, 890 aa, unidentified
  REGION 1..890: note = Description of Unknown: uncultivated organism
  REGION 1..890: note = MG4-168 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKW

SEQ ID NO: 587 - protein, 1062 aa, unidentified; identical to SEQ ID NO: 575
  REGION 1..1062: note = Description of Unknown: uncultivated organism
  REGION 1..1062: note = MG4-169 effector

SEQ ID NO: 588 - protein, 1079 aa, unidentified; identical to SEQ ID NO: 544
  REGION 1..1079: note = Description of Unknown: uncultivated organism
  REGION 1..1079: note = MG4-170 effector

SEQ ID NO: 589 - protein, 902 aa, unidentified
  REGION 1..902: note = Description of Unknown: uncultivated organism
  REGION 1..902: note = MG4-171 effector
ILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 590 - protein, 1062 aa, unidentified
  REGION 1..1062: note = Description of Unknown: uncultivated organism
  REGION 1..1062: note = MG4-172 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 591 - protein, 766 aa, unidentified
  REGION 1..766: note = Description of Unknown: uncultivated organism with predicted taxonomy: Ignavibacteriales bacterium CG_4_9_14_3_um_filter_30_11
  REGION 1..766: note = MG4-173 effector
LRLRLDDGNERKLTPNERAVLLDLCEKREKLTIAKARSEIGISKGQKFTIEEGGEKNVPVNLTATRLRAALGQTWDGLTPLQKDDLVEDVGDGKRNPTDEGLERCGRDKWGLPQEIAEALGKVRLPDAYGRYSLRALVALLPAIEEGLTVEDAIRALYAGARKSAEPLPLLPPVRDEKMKTLLGEIRSPAVQRSLTELRKTVNAIIRRYGLPEKIHIELARDLKKSKKERQKQTEINRDREKLRQEATGELRKHDVVRFANPRNSDIEKYLLATEARWQCPYTSKKYGVTDVFGDHPQVDVEHIIPRSRSLDDSYLNKTLAYRSANMEKGNRTPREWLFESDQEQYDRMIGVVSGFDPRFEVGKKLRRFSMELSDPDSLLKEFTERQLQDTRYASKLACRYLGVLYGGTSDASGNQRVFASAGQVTAKLRRAWDLDRILSPDKPEKSRDDHRHHAIDALTVALSSTTLIRALATAAGEADRLFRRKIILPVPWVGFGEQARSAVENIQPSHRPMRKLSGPLHKETFYSRPRKHAVGTDRKGKPIEEECVHYRVPVTSLSSAKSFESIVDSRVRAAVEERAAQLGGGGNRFEKNWPELVTRKGQTVPIKRVRIRKVEGVVSIGKNGRERFVIPGSNHHAEILAELDANGRVKRYLCETVTMLEAVERKRQSVPVVNRDHGPGYKFHCTLSEGDLVEARGPGDEASRIWKVRTVRESQQLALTPALDARPKAVVQKDGMWSPSVNPLFRGGARKVLITPLGEVIPAND

SEQ ID NO: 592 - protein, 764 aa, unidentified
  REGION 1..764: note = Description of Unknown: uncultivated organism with predicted taxonomy: uncultured bacterium
  REGION 1..764: note = MG4-174 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHA

SEQ ID NO: 593 - protein, 1079 aa, unidentified; identical to SEQ ID NO: 544
  REGION 1..1079: note = Description of Unknown: uncultivated organism
  REGION 1..1079: note = MG4-175 effector

SEQ ID NO: 594 - protein, 1062 aa, unidentified
  REGION 1..1062: note = Description of Unknown: uncultivated organism with predicted taxonomy: Acidobacteriales bacterium 59-55
  REGION 1..1062: note = MG4-176 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 595 - protein, 948 aa, unidentified
  REGION 1..948: note = Description of Unknown: uncultivated organism
  REGION 1..948: note = MG4-177 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDPWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLL

SEQ ID NO: 596 - protein, 878 aa, unidentified
  REGION 1..878: note = Description of Unknown: uncultivated organism with predicted taxonomy: Acidobacteriales bacterium 59-55
  REGION 1..878: note = MG4-178 effector
KKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 597 - protein, 1106 aa, unidentified
  REGION 1..1106: note = Description of Unknown: uncultivated organism with predicted taxonomy: Acidobacteria
  REGION 1..1106: note = MG4-179 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 598 - protein, 1076 aa, unidentified; identical to SEQ ID NO: 545
  REGION 1..1076: note = Description of Unknown: uncultivated organism
  REGION 1..1076: note = MG4-180 effector

SEQ ID NO: 599 - protein, 1079 aa, unidentified; identical to SEQ ID NO: 544
  REGION 1..1079: note = Description of Unknown: uncultivated organism
  REGION 1..1079: note = MG4-181 effector

SEQ ID NO: 600 - protein, 1062 aa, unidentified; identical to SEQ ID NO: 549
  REGION 1..1062: note = Description of Unknown: uncultivated organism
  REGION 1..1062: note = MG4-182 effector

SEQ ID NO: 601 - protein, 766 aa, unidentified
  REGION 1..766: note = Description of Unknown: uncultivated organism
  REGION 1..766: note = MG4-183 effector
MSDNGSLAQDYILGVDLGSASLGWAAIRQDENGMATRLLRAGVRIFDPAVSGDVEKGQDESNAVARRTARLIRRQLRRRAARQSELFRLLQTRGLLPSYQGSEADASQQRHTILNALDLKLAAKWAKSGSNEEQTAIELPLYLLRKTALDAALEPYELGRVFYHLSQRRGYRSNRKEQASGKEASGKAKKADDLGAVEGGIKELEEAMHPFRTLGEYFASLDPHIQKVRRRWTGRKMYEDEFAAIWAKQAAFHPDLLPEELHHQIKRLLFYQRPIKAQSNLIGGCELEPGERRAAWATLEAQQFRVLQKVNDLEIILPGNVTGIPLTPEQRKIVLDLLENSAEATFKKIRKALGLAENIGFNLQRGGDTRLKGNLTNTLMAEAFAERWPEMSNEEKMQAVEDWRTIEQKESLVRRAIEHWKLDETGAQWLAEKPAPNGYCMYSRKAIRKLLPLMATGTRFKAAEKEIYGNRLAGGKVYDRIPPVRDALKTLRNPAIERALTELRKVINALVHEHGKPAEVRIELARDLKKPRHERAKAVSYNRDREKQRTTAKEKMLREVGPGFQHPSRADVEKALLWEECQGECPYTGKRFPFSSLFGENPPLQVDHIIPFSRIPDDSFQNKTLCYHEENQHKGNRTPFEAYTDPAQYEAILNRVRSWRTPNPGKQRRFELRTLEELEGFSERQLNDTRYASKLACELVGTLYGGRDVPLKDGKSRQVVFASSGMVTSTLRKGWGLEAILREAAPSANGQNRGKPRTDHRHHAID

SEQ ID NO: 602 - protein, 1076 aa, unidentified; identical to SEQ ID NO: 545
  REGION 1..1076: note = Description of Unknown: uncultivated organism
  REGION 1..1076: note = MG4-184 effector

SEQ ID NO: 603 - protein, 1062 aa, unidentified
  REGION 1..1062: note = Description of Unknown: uncultivated organism
  REGION 1..1062: note = MG4-185 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 604 - protein, 1079 aa, unidentified; identical to SEQ ID NO: 544
  REGION 1..1079: note = Description of Unknown: uncultivated organism
  REGION 1..1079: note = MG4-186 effector

SEQ ID NO: 605 - protein, 794 aa, unidentified
  REGION 1..794: note = Description of Unknown: uncultivated organism with predicted taxonomy: Polaribacter sp. ALD11
  REGION 1..794: note = MG4-187 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIEKDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 606 - protein, 1062 aa, unidentified
  REGION 1..1062: note = Description of Unknown: uncultivated organism with predicted taxonomy: Acidobacteriales bacterium 59-55
  REGION 1..1062: note = MG4-188 effector
MSAALEQQKYVLGLDLGSASLGWALIALNGADDPVSLIRAGVRIFEPGVDGTSMEIEQGKDQSKAVERRTARLHRRQLRRRAARQRDLFRVLQRHCLLPAPETLVGSPEEQRHSVLNELDQELTQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 607 - protein, 1106 aa, unidentified; identical to SEQ ID NO: 597
  REGION 1..1106: note = Description of Unknown: uncultivated organism with predicted taxonomy: Polaribacter sp. ALD11
  REGION 1..1106: note = MG4-189 effector

SEQ ID NO: 608 - protein, 1076 aa, unidentified; identical to SEQ ID NO: 545
  REGION 1..1076: note = Description of Unknown: uncultivated organism
  REGION 1..1076: note = MG4-190 effector

SEQ ID NO: 609 - protein, 1079 aa, unidentified; identical to SEQ ID NO: 544
  REGION 1..1079: note = Description of Unknown: uncultivated organism
  REGION 1..1079: note = MG4-191 effector

SEQ ID NO: 610 - protein, 983 aa, unidentified
  REGION 1..983: note = Description of Unknown: uncultivated organism
  REGION 1..983: note = MG4-192 effector
RRAARQRDLFRVLQRHCLLPAPETLVGSPEEQRHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 611 - protein, 1062 aa, unidentified; identical to SEQ ID NO: 549
  REGION 1..1062: note = Description of Unknown: uncultivated organism with predicted taxonomy: Acidobacteriales bacterium 59-55
  REGION 1..1062: note = MG4-193 effector

SEQ ID NO: 612 - protein, 1022 aa, unidentified
  REGION 1..1022: note = Description of Unknown: uncultivated organism
  REGION 1..1022: note = MG4-194 effector
MNESGSLAQDYVLGIDLGSVSLGWAVIGLDKTDMPVVLLRAGVRLFDPAVTGDIEKGQDESNAVARRVARLLRRQLRRRAARQSELFRLLQGHALLPPYEGNEADASQQRHAILNALDLEIAAKWAKSGGAGAQAAIDLPLYMLRKTALDEALEPYELGRVFYHLSQRRGYRSNRKEQAEKKEAAIKGKKDDDLGTVESGIKELGEAMRSFRTLGEYYASLDPHTHNVRRRWTSRKMYEDEFAAIWEKQAALHPTLLTEELHRQIKHLLFYQRPIKAQSHLIGGCELEPGEPRAAWAALEAQQFRVLQQVNELEVISPGRVTGIPLTAEQRQTVLDLLENSSEITFKKISKALGLADYIGFNLQRGGDTKLKGNLTNTHMAEVFAERWTEMSEEEKKQVVEDWRTIDQEDSLIRRAIEYWNLDESSAKWLASRPAPNGYCMYSRKSIRKLLPLMATGARFRAAEKEVYGIRLTGGLVYDSIPPVRDTLKTLRNPAVERALTELRKVVNALVREYGKPTEVRIELANDLKKPRHERAEAFKYKRKWEKQRIDTKEKMLRELGPGFEYPSRADVEKALLWEECQGECPYTGKRFPFSSLYGENPPLQVEHIIPFSRIPDDSFQNKILCYHEDNQHKANRTPFEAYTDPAQYETILSRVRNWRTPNPGKQCRFELRTLEELEGFSERQLNDTRYACKLACELVGTLYGGRDEKTDTDSRQVVFASSGMVTATLRKSWGLEAIMRETAPSANGQNHGKPRTDHRHHAIDAITIALSRPKMIATLSRNNAQDSYRPSNGHTAPRIQSPWEDFVDSIRPHFEKMLVSHRPDHRLTGALHDETNYGRPHKEEGKDVVHIRKPVEGLSARDINNIVDPAVREAVRAKAAQLGGDLKKWTPKEGRGDWPQLGTKNGKQIPVKRVRIKKALSVETIGKDERTRHVALSSNHHVAIFAMLDKRGIEKRWKSIIVSLFEAMDRKRKGQPIVQTSYPEAGDYVFKFSLMGGDTVLLHKDCDHNQNPCNPSVWRLR

SEQ ID NO: 613 - protein, 1062 aa, unidentified; identical to SEQ ID NO: 594
  REGION 1..1062: note = Description of Unknown: uncultivated organism
  REGION 1..1062: note = MG4-195 effector

SEQ ID NO: 614 - protein, 862 aa, unidentified
  REGION 1..862: note = Description of Unknown: uncultivated organism with predicted taxonomy: Acidobacteriales bacterium 59-55
  REGION 1..862: note = MG4-196 effector
DKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 615 - protein, 1062 aa, unidentified
  REGION 1..1062: note = Description of Unknown: uncultivated organism
  REGION 1..1062: note = MG4-197 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 616 - protein, 1084 aa, unidentified
  REGION 1..1084: note = Description of Unknown: uncultivated organism
  REGION 1..1084: note = MG4-198 effector
MSAKSEELKGAPYILGLDLGAASLGWAVVGLADGKPACHVDGGVRIFPEAVENLEQGKDDPKSAQRRLARQMRRQTDRRARRVASVFRVLQKAGLLPRFSEGADPADPLARHELINRLDEDLACTVPGLIDPAAEHRSRSVFHYRLRALAIHQDLPPYAIGRAFLHIAQRRGFKSGRIEEASGSEKAKERESDSRKERRQVAARIESLPAEFLRLGACTIGEYWSKLDPNQKRIRGIGNWSGRQMHVDEFDRIWERQAPRQQEIMTPLLYRIVKRRIFFQRPLKSAAGLIGHCELERESQRRRAPLAHPLYQRFRILQTVNDLRIVEGSGLSRPLTVEQRIKALDTLSRQQTVTFKSLHKKLGLVPGETFSHEEGDRKDLPGNRTECKLREVFGEQWDSLPEQQKNVIAGYVRSMDDSAVLARIAETRWGLGHLRAARLAGIQLEQGYGRLSVAALRKLLPLMEEGLPYMTAVERIYPDRAFAPTQELLPKVLDLKNVRNPAVVRALTELRKVVNGVIREYGRPERIQIELARELKKPAKARERIAQENRQREDLRKKTIERIFRECGLGKPSNADIEKAILWEECQHHDPYTGGSINFHDLFGSDAKWEIEHIIPHSRSQDDSLTNKTLCSRETNRQKGNRTPFEVFGNTPEWEAMVERVTKFQGDKRAMTRKLARFTMEGGVEELFGEFTQRQLNDTKYASLLAMEFLGQLYGGVCDERGIRRVNAVSGGVTAQIRKGWRLHSILRDGPSQGEAKPRDDHRHHAIDALVIAMTDAGAVQAVSRASERSRLDHRHGFRVDDPWNGFLEQVQAVIRAIRVSHRPDHHLRGALHAESLYSPPRSERGAAPRHRIRKWLSSLTPEQVRDIVDTKVREAVEAKLKELGQTDPRDAFKNNADPPTLGNRHGDPVPIRRVRVYVSVSPQRIGTGATARHVVSKDNHHLAIYRLSADKKGTARWTGEAVSLLEALKRMNLPGRPVIAPVNESGAPLVMALYKGDLVEMTVPKSQPPERDLFVVRGFSIEKRGGPEINFVRHNLAAEIADLKDAGEWQRIRSWDELRLLNPRIVRLGAMGRVMPDDSQPNS

SEQ ID NO: 617 - protein, 1079 aa, unidentified; identical to SEQ ID NO: 544
  REGION 1..1079: note = Description of Unknown: uncultivated organism
  REGION 1..1079: note = MG4-199 effector

SEQ ID NO: 618 - protein, 1079 aa, unidentified; identical to SEQ ID NO: 544
  REGION 1..1079: note = Description of Unknown: uncultivated organism
  REGION 1..1079: note = MG4-200 effector

SEQ ID NO: 619 - protein, 1106 aa, unidentified
  REGION 1..1106: note = Description of Unknown: uncultivated organism with predicted taxonomy: Acidobacteriales bacterium 59-55
  REGION 1..1106: note = MG4-201 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTSPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 620 - protein, 1062 aa, unidentified; identical to SEQ ID NO: 549
  REGION 1..1062: note = Description of Unknown: uncultivated organism with predicted taxonomy: Acidobacteriales bacterium 59-55
  REGION 1..1062: note = MG4-202 effector

SEQ ID NO: 621 - protein, 1062 aa, unidentified
  REGION 1..1062: note = Description of Unknown: uncultivated organism with predicted taxonomy: Acidobacteriales bacterium 59-55
  REGION 1..1062: note = MG4-203 effector
MSSALEQQKYVLGLDLGSASLGWALIALNGADDPVSLIRAGVRIFEPGVDGTSMEIEQGKDQSKAVERRTARLHRRQLRRRAARQMDLFRVLQRHFLLPSPETLFGSPEEQMHSVLNELDQELTQKWQSTYQGIRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 622 - protein, 830 aa, unidentified
  REGION 1..830: note = Description of Unknown: uncultivated organism with predicted taxonomy: Acidobacteriales bacterium 59-55
  REGION 1..830: note = MG4-204 effector
MFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 623 - protein, 819 aa, unidentified
  REGION 1..819: note = Description of Unknown: uncultivated organism with predicted taxonomy: Acidobacteria
  REGION 1..819: note = MG4-205 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSR

SEQ ID NO: 624 - protein, 1062 aa, unidentified
  REGION 1..1062: note = Description of Unknown: uncultivated organism
  REGION 1..1062: note = MG4-206 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHSLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENAPCLESRDGRFIPIRKVRIREAKKPILVGTGVRERYVASGGIHHIGLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 625 - protein, 1056 aa, unidentified
  REGION 1..1056: note = Description of Unknown: uncultivated organism
  REGION 1..1056: note = MG4-207 effector
MAAIAPPSFRPGLVLGIDLGSNSLGTALIRTDLDLIEFMGVRIFPAGVEGNLEEGKEESRAAKRRQARLARRQTQRRQRRLYKVFHFLQRIGLLPTGDRLEVLGRLQNELEHCYPQTTVLPWFLRARALDQALGPHELGLALYHLAQRRGFLSNRAGGKDNEKERSEVKASIKGLAAAIEAAGKRTLGEYMASLNPREKLRNSAEFSGHYTHRSMFEREFDMIWDSQKAHHPEILTENHGAKLHDAMFHQRPLKDQSYLVGQCELEPTEKRAPLRLLAAQRFRILGFVNNLRLRLEDGNERKLTPNERAVLLDLCEKAEKLSLAAARRVLGLSTAQRFTIEEGGEKNVPVNLTATRLRAALGQAWDGLTAAQKDDLIEDVGDGKRCPTDEDLERCGREKWGWPQEVANALSKVRLPDGYGRYSLRALVALLPALEGGITVEEAIRAIPAYAETRNAAEPLPMLPPVRDLKAMLGEIRNPAVLRSLTELRKTVNAIIRRYGIPEQIHIELARDLKKSKKERQYQAELNREREKMRQEATEELRKYDAVRFANPRNTDIEKYLLAKEARWQCPYTNKKYGFTDVFGDHPQVDVEHIIPRSRSLDDSYVNKTLAYRSANAEKGNRTPREWLFESDQEQYEQMIRVVKQFDPRFEVGKKLRRFSMELSDPDSLLREFTERQLQDTRYASKLACRYLGVLYGGTIDASGKRRVFASAGQVTAKLRRAWDLDRILSPDKPEKCRDDHRHHAIDALTVALSSTTLIRELARAAGEADRLFRRKIILPVPWVGFGEQTRSAVERIQPSHRPMRKLAGPLHEETFYSRPRKEAVGTDKKGNPIKKEFVHYRVPVTSLASAKDFESIVDSHVRAAVKEKAAQLGGGGNKFEKNWPALVTRKGQTVPIRRVRIRKVQSVVSIGKDERKRFVVPGSNHHAEILKELDANGRVKRYLCETVTMLKALERKRQGVPVVSRDHGPGYKFHCTLSEGDLVEARGPGDEALRIWKVRTVRDSQQLALTPALDARPKADVQKDGMWSPRVNSLFLGGARKVLITPLGEVIPAND

SEQ ID NO: 626 - protein, 1076 aa, unidentified; identical to SEQ ID NO: 545
  REGION 1..1076: note = Description of Unknown: uncultivated organism
  REGION 1..1076: note = MG4-208 effector

SEQ ID NO: 627 - protein, 1079 aa, unidentified; identical to SEQ ID NO: 544
  REGION 1..1079: note = Description of Unknown: uncultivated organism
  REGION 1..1079: note = MG4-209 effector

SEQ ID NO: 628 - protein, 827 aa, unidentified
  REGION 1..827: note = Description of Unknown: uncultivated organism with predicted taxonomy: candidate division Kazan bacterium
  REGION 1..827: note = MG4-210 effector
QMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSH

SEQ ID NO: 629 - protein, 845 aa, unidentified
  REGION 1..845: note = Description of Unknown: uncultivated organism with predicted taxonomy: Acidobacteriales bacterium 59-55
  REGION 1..845: note = MG4-211 effector
RIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 630 - protein, 1076 aa, unidentified; identical to SEQ ID NO: 545
  REGION 1..1076: note = Description of Unknown: uncultivated organism
  REGION 1..1076: note = MG4-212 effector

SEQ ID NO: 631 - protein, 1106 aa, unidentified; identical to SEQ ID NO: 597
  REGION 1..1106: note = Description of Unknown: uncultivated organism with predicted taxonomy: Polaribacter sp. ALD11
  REGION 1..1106: note = MG4-213 effector

SEQ ID NO: 632 - protein, 1079 aa, unidentified; identical to SEQ ID NO: 544
  REGION 1..1079: note = Description of Unknown: uncultivated organism
  REGION 1..1079: note = MG4-214 effector

SEQ ID NO: 633 - protein, 1109 aa, unidentified
  REGION 1..1109: note = Description of Unknown: uncultivated organism
  REGION 1..1109: note = MG4-215 effector
RSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKHNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTRYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 634 - protein, 1062 aa, unidentified
  REGION 1..1062: note = Description of Unknown: uncultivated organism
  REGION 1..1062: note = MG4-216 effector
MSAALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQKAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDEVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPAPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 635 - protein, 754 aa, unidentified
  REGION 1..754: note = Description of Unknown: uncultivated organism with predicted taxonomy: candidate division Zixibacteria bacterium CG_4_9_14_3_um_filter_46_8
  REGION 1..754: note = MG4-217 effector
LSENTPRIAEDLILGLDLGTNSLGWCLLSAPEGNPASIVAIGVRSFDAGGDISAANGKSPCVIRREARVARRVVARRAKRLRDALRALQAAGLLPAGKAKDVIPPLDAAWLEERLSSFPQRDPERLRQAHLLPYLLRKEALDRPLTRQELGRALYHLAQRRGFLTNRKAEPKKDEKPGEVKQSIDSLRGKMEQAHARTLGEYFAGLDPQETRIRRRWTARGMYLDEFECIWTAQAPHHAEVLTSALKADLYRAIFRKRPMSSAASLVGPCAHEPNRRRAPACILPAQRFRLLQQVINCRVIEPNQVGRLLTDEEFAKLVQALEERDEMTVTEAKKVLGLPSRSKFTFEEGGEKKFNGNGTNAGLANVFGPAWETFTPDQRDAVVTEVRSFEDPEALIRRATSGRAFWNLDAQAGKALADVRLQQGYCALSRRALERLLPLMESRVPYQTAVEQIYKESCRKTAVKDLLPRVSELKELRNPVVSRVLTETRKVVNAIIRKYGIPGRVRIELGRDLKQSKDHRLRATKNARDNEESRKAAIRKILAETPVRSPGPDDILRAQLYEECNHECPYTGRKIAFAALFGDSPQFDIEHIIPFSRCLDDSFANKTLCYHEVNRHVKGNRTPLEAFGSTPEWERIVQSVRLFSGKAAEGKLRRFLMTEEEILKLQDFANSQLSDTRYASKLAMRYLALLYGGLSDEGGTQRIQAGSGNVTKHVRQAHRLNGILGDGPGKNRNDHRHHAVDALAIALTDQALV

SEQ ID NO: 636 - protein, 1045 aa, unidentified
  REGION 1..1045: note = Description of Unknown: uncultivated organism with predicted taxonomy: Planctomicrobium piriforme
  REGION 1..1045: note = MG4-218 effector
MANPTGVPYILGLDIGASSIGWALLAANTDRSERLLRCGARVFDAGMEEGDFSAGKENSRSAVRRLARQARKLTSRRMRRQRKLFNLLVKAGLLPAGEPSQVVPALDADLRRKHVAMLPKGSDARRQAEHVLPYRLRALALDQKLEALELGRAIYHLAQRRGFLSNRKAPPRKDEKPGEVKEHITELEKNIKAAGARTLGKYLSGLDPEQERIRRRWTSRPMYLDEFAVLWAAQAAYHPAILTDDLRKRIHRAIFHQRPLKNQSNLIGTCELERGRQRAPKALLLFQRFRTLQQITSARVVARSGAGRELGAAERATLLAALDRQGELAFSKAKKLIGLPPGSTFNWESGGEDKFNGNHTGARLAEIFGDRWHRMCPSGKDQVVEDVLSIHSDAALERRGLKWDLDSEAAARFGHVNLEDGHGGLSRQALQKLVPLMEQGVPYATAVDKVYGRKEHKPLEVLPPPAPTYPHLRNPMVLRVLAELRKVVNAVIAAHGKPDAVRVELARDMRRSKKQRQESWLRMRQNERDRKRAAQKILAEMNNDSPSRQDKEKVLLAEECNWTCPYTGKCISMQSLLGPTPQFDIEHIIPFSRSLDDSFTNKTLCDIAENRDHKRNRTPFEAYAAEPDKWNAILGRVGRFRSNAREEKVRRFRQEEIEGIEDFAARQLNDTRYATRQATDYLALLYGGLYEKGGKRFIQAAKGGTTAYLRNEWQLNSILGDGGTKSRDDHRHHAVDAVAIALTDAGTVKMLSDAAGRAAQEGRRRFGRVEDPWPGFLDDVRQAIEGLNVSHRVSRKVNGPLHEETNYGPGKKRDAAGRPESLSVRKRLDALTPADMKLIADERVRGLVTAKLATLGGDAKKAFSDVKNHPCFELKDGRRIPIHAVRLRRSGTALAVGEGARVRYVLTGSNHHMELYEVTDAKGKTRWKGRVVSRFEAIRRQGRKQPVVDRTPPDGGTFKFSLAPGEIVHLTDEKGEARLYRVRTVSQAASGSIEIAGAKVNDARLKDEIIKGGDWLRITSMDKVAAMSCHKVIITPLGEIRDAND

SEQ ID NO: 637 - protein, 1076 aa, unidentified
  REGION 1..1076: note = Description of Unknown: uncultivated organism with predicted taxonomy: Candidatus Sulfotelmatomonas gaucii
  REGION 1..1076: note = MG4-219 effector
MSSALERPQKYVLGLDLGSASLGWALIALNDADNPTSLIRAGVRIFEPGVDGTSMEIEQGKDQSKAVERRTARLHRRQLRRRAARQRDLFRLLQRHSLLPAPETLGGSPEEQRHSILNGLDQALARKWQSAFPDNRFAQLPLYYLRKRALDEPLEAHEIGRILFHLIQRRGFLSNRRENKQNPDQKKELGQVKAEIHSLEQEIQNAGARTLGEFFAGLDPHAQKVRRRWTARKMFQNEFEKIWEAQVIHCPNLLMPELHDKIAHLLFFQRPIATQSHLVGKCELEPGKQRAPWAAMEAQRFRILQKVNDLRLVNPGSLISDPLTEEDRQRLNSLLDREGDQTFKAIKKYLSFPADVQFNLEKGDEKRLRGNRTQAAMRKVFGDRWDRMSAGKQHQIVENWRNSESDEALIREAEEQWSLDDTAATLLSEQIPEPGYCAVSLTAISKLLPLMQCGKSFKEAETVVYGARFSGGVVFDTLPEVRKQLESLRNPAVERALTELRKVVNAIVREYGKPYEIRIELARELKKPRQERLEATKKNRTRQREREDIAGKILRECGLSNPSRKDIEKARLHEECGGICPYTGRHIPFSTLFDNSEFDVEHIIPRSRYPDDSFQNKTLCYLPENRDVKKGQTPWEAYGKDEQRWAEIMTRVGSWKNRGKMARFSIQTEEALGEFSARQMNDTRYASVLAARFLGSLYGGRDVVDGDNARQVIFASSGAVTATLRSSWGLEAILHEIVPAESGESRGKPRTDHRHHAIDAITIALTRSKVIQSMARTASLEPWQIDSRAWRKIELPWRDFVPSIRPHIEQMLVSHRPEHKMSGELHKGTNYSTPYNYKGKPTVHTRCLLSALSAADIAGDEVIVDTAVRDAVRKKLAELGGNPKLFDRPENAPCLSARDGRLIPIRKVRVRETKNPVKVGKGVRERFTSSGGIHHVALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 638 - protein, 1068 aa, unidentified
  REGION 1..1068: note = Description of Unknown: uncultivated organism with predicted taxonomy: Proteobacteria
  REGION 1..1068: note = MG4-220 effector
MSTALVPSDYILGIDLGSNSIGWAMIGLDQGKPTGLIRAGARVFDAGMEGDLESGQEESRNVARRDARMQRRQMARRARRLTKIFHILQRIGLLPPADLKTPEQRQEFLNQLDSNIIGSDWFKTKRAGNNFGEIDQVMPYLLRAAALDEPLDPHQLGRALYHLGQRRGFLSNRKKPMKKGEDEGVVKESIAELRQKMQESGARTLGEYFMRINPFERRIRQRWTHRDMYEGEFEKIWEAQAAHHPLLLTPERKKELKRAIFYQRPLRFPRELVGHCELEPEEIRAPRHYFIAQRFRLLQSLNNLRVAMPGEAERDLTAEERAKLDNELELHGDRTFGQIRKLLGIKRATFNLESGGEKLLRGNRTTAQFYKVFGERWLEMSSVEHEQALQDVRSIVKDETRLRRGSEHWKLDPEHAREFAAISLEPDYFNLSRKAMERLLPLLETGVSYATARRQLYPERFQAREPVPLLPPLHDVFEYLRNPAVERSLTELRKVVNALVRQYGKPAQIRLELARDLRKSRKEREANWKKNRDIEKSRKIMAERITAEAGITDPSREDIRKALLAKECGWVCPYTGRAISMRALVGPDAQFDIEHIIPFSQSLDNSFFNVTLCYHEENRNRKRNQTPYGAYGNEPEKFQEILDRVRRFDSDLADEKLKRFQLTDTADILKGFVDRQLNDTRYASTMAGDYLGFLYGGKIDSQRNLRVRATTGQVTAYLRDEWMLNRILRDGPTEQGGKVAKSREDHRHHAVDAIAIALTDESTIQQLSRAAQQAPQLGRRRFAPVQAPWPDFVDSVRAEIGRIVVSHRPNRKVSGALHEETLYSKSMPVPDSLKSQEKAPRVRKPLERLSKSEVEDIADPIVREMVQKKLEQLDGDPKKFSVAANLPFFKTADGREIPIKSVRVIKKTPTFPLGMGSRMRNVTSESNHHLEIFAELDEHGEEVEWDGVVVPMAEAYKRLAEAKRLRTKVPIVQRDFGAHRHFKFSLAAGDVVQCDNNHEGRRLLVVRGTSIEGGKTGRVALVPINDARKKNEIVASKDYFRFPLEKLRKLHTCKVTLSPLGDLGTAND

SEQ ID NO: 639 - protein, 876 aa, unidentified
  REGION 1..876: note = Description of Unknown: uncultivated organism with predicted taxonomy: Acidobacteriales bacterium 59-55
  REGION 1..876: note = MG4-221 effector
TGRKMFEKEFQMIWDKQKEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQSMARASALEPWQPGTRSWRHVPQPWCTPDFFRSVEEQVREMLTSHRPEHKVSGELHQGSNYARPYMYKGKSIVHSRTLVSELKVEQIEADDVIVDRAVRDILRAKLKEIGGTLKGSDKVKTFEKPENTPYILTPAGKRIPIRKVRIRETKNPLLVGAGSNERFVASGGIHHVDLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 640 - protein, 1062 aa, unidentified
  REGION 1..1062: note = Description of Unknown: uncultivated organism
  REGION 1..1062: note = MG4-222 effector
MSSALEQQKYVLGLDLGSASLGWALIALNDADDPVSLIRAGVRIFEPGVDGTSIEIEQGKDQSKAVERRTARLHRRQLRRRAARQRDLFRVLQRHCLLPAPETLVGSPEEQRHSVLNELDQELAQKWQSTYQGKRFAELPLYYLRKMALDERLEAHEIGRILFHLIQRRGFLSNRRENKQNPDQKKELGQVKAEIHSLEQEIQNAGARTLGEFFAGLDPHAQKVRRRWTARKMFQDEFEKIWEAQTAHRPELLTQELHDKIAHLLFFQRPIAAQTHLIGKCELETGKQRAPWAAMEAQRFRILQKVNDLRLINPGSLISDPLTEEGRQRLYHLLDREGDQTFKAIRKYLSFSAEVQFNLEKGDEKRLRGNRTQAAMRKVFGERWDTIGEGKQHQIIENWRNSESDDVLIREAMEQWSLDAAAATLLSEQTPEPGYCAVSLAAISKLLPLMASGKSFKEAETELYGARFSGGTIFETLPEVRKQLESLRNPAVERSLTELRKVVNAIVREYGKPHEIRIELARELKKPRQERIEATKKNRNRQREREDVAVRILRECGLSNPSRRDIEKARLHEECGGYCPYTGRHIPFSTLFDNSEFDVEHIIPRSRYPDDSFQNKTLCYLPENRDVKKGQTPWEAYGKDEQRWAEIMTRVSSWKNRGKMARFAIQTEEALGDFSARQMNDTRYASVLASRFLGALYGGRDLVDAEKVRQVIFASSGAVTATLRSSWGLEAILREIVPTEPGESRGKPRTDHRHHAIDAITIALTRPKVIQSMALAASLEPWQRDSRAWRKIESPWRDFVLSIRPHIEQMLVSHRPEHKMSGELHKGTNYPPPHNYKGKPTVHTRCALSALSAADIADDEVIVDPAVRDAVRAKLEKLGGNPKLFDRPENVPCLESRDGRFIPIRKVRIREAKKPILVGTGVRERYVASGGIHHIGLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 641 - protein, 1079 aa, unidentified; identical to SEQ ID NO: 544
  REGION 1..1079: note = Description of Unknown: uncultivated organism
  REGION 1..1079: note = MG4-223 effector

SEQ ID NO: 642 - protein, 1076 aa, unidentified; identical to SEQ ID NO: 545
  REGION 1..1076: note = Description of Unknown: uncultivated organism
  REGION 1..1076: note = MG4-224 effector

SEQ ID NO: 643 - protein, 1179 aa, unidentified
  REGION 1..1179: note = Description of Unknown: uncultivated organism
  REGION 1..1179: note = MG4-225 effector
MSFPDGVRQKYILGLDLGSASIGWAVIDLDGNLDPCGLLAAGSHIFDPGVEVPPAAGKMARDEAVFQGLDRSKAVGRRIARQMRRQIDRKGIRLKALFKLLQSKSLLPIYPELKGEPLAAERHHLFTRLDKELTDALCAEKRKRGTDGLMLEADQALPYVLRKEALERKLELHELGRALYHLCQRRGYRPSAADDSEKEETASTEEEIESKRGRRKKPEPEDKGDKDSESPKKVAEWISDLQAKMDAAHTPTIGAYFADFKNNNPHQERIRHRWTGREMFVKEFDLIWERQSEFYRDSRPGLLNDDLRNRVYDCLFFQRPLASAEHLIGMCDLERGERRAPWATLEAQRFRLLQKVNDLAYIPSGLFNERKLSLEQCATLAAALQDKGDMPFPEIAKLLGLPPKTEFNLMRGKKKKIEGNRINQVMLQVFGDRWRAFTEQERSSAVALWTKTEGFEERKNVAISQCGLDAWKAKEWAENRPPKDCCRHSRKALVKLIKRMEEGVPYATAKLEIYDSQLAGKAPLDFVPKVIETLPSINNPAVLRALTELRKVVNAIIRTYGDKPYEIRIELARELRKNRKQRQNATEAGDKQHLRRIDAARTILRECRNYDAQGRDAERLVRERRDDVTKMLLLMECRCLCPYTGDSISYLDLFGGEVEVEHIIPQSLMVDNSFNNLTLCYRKVNHEKLDKTPRQAFCRAEDDQQWIDIIGRVQKFGNKEKLHRFLLSSREDIDRFSNRRLNDTLYTSKLAGRLLMSLYGGRDIVPAETLDELDEFKDRTGRRAICVSSGMVTSLLRDAWHLNLSGVIGDDAFKCPKKSEDDEESGKRRKGQSNKKDRCDHRHHALDAVVIALTSEKVIREINMLASRLYRERQTPLKYRDLKSIQNPWHNFMDDHFRDIFRGMLVSHRPEHKLSGALHEATSYGKVRYYNAKGDPVRYQRIAIGKLLTDKQIEKIVDEEVKKSVVKLGETIGGYKKWSQEKHGWPKMPNRNGEPVPIKKVRIKITKNAKEIEAERFRGFGTGRPESNVEDKEIAYASFFTVQDRKGTKTVWEIVKLFEAAQRVRALPKSERGHEKICWKYPKYPDATFFRFSLMKGDLVELVLNGKPAIFIVRRFEFDSRLWVAPINAAGKDEEMEAAGHLLRLGFSRFLTMGAGDDKIPRPVFVDLLGQPHYINIGA

SEQ ID NO: 644 - protein, 794 aa, unidentified
  REGION 1..794: note = Description of Unknown: uncultivated organism with predicted taxonomy: Polaribacter sp. ALD11
  REGION 1..794: note = MG4-226 effector
MSESGVSTQPYVLGLDLGSASLGWALVGIDAMERPSSLIRAGVRIFEPGVDGSALDIQQGKDQSKAVDRREARLRRRQLRRRVARQRELFGVLQGAGLLPTDDTQGTGIGSEQRHRILNNLDVTLSNRYRNGADQEIFAQMPLYALRKKALYEPLALDELGRVFFHLSQRRGFQSNRKDVKKKTKDSEDQGQVKSAIHELEQAIEAAGAQTLGEYLAGLDPHEQKVRRQWTGRKMFEKEFQMIWDKQNEYHTDLLTPELHDRIWNLLFFQRPVAAQKHLVGKCELEPDKRRAPWAALLAQQFRLLQKVNDLRLIGEDGNELPLNEDGRAAVFDLLENHGTQSFAKIKQHLGLPKTAQFNLERGKAKELKGNVTAQSMRKVFGERWKEFSEGKQNQIIENWRNSEKDEELKREAMEHWGLDEAGANALVNEKAPGDYCSLSLVALGKILPLMRAGKSFKEAETEIYGNRFSGAAVHSIIPVLRPNRKHFRNGTPPPQDPLMASIANGLRNPAVERSITEMRKVVNAIVREYGKPCEIRIELARELKKPRSKRLDETARNRKREAENKALAERMHNECGTPQNPSRNDLEKAKLWVEQQGECPYTGRSLPFSRLFDDNNGFDVDHILPRSRHPDDSYQNKVLCWGDTNRMVKRNQTPYEAFAEQDPENWHQILARVARWKNPGKLRKFEIRSTDDLAEFSSRQLNDTRYTSLLAARLLSTLYGGRDVAENGGKRQIIFASTGAVTATLRRNWGFEQILRNIIPPEPSESTGKPRTDHRHHAIDAIVIALTRNDVIQ

SEQ ID NO: 645 - protein, 1079 aa, unidentified; identical to SEQ ID NO: 544
  REGION 1..1079: note = Description of Unknown: uncultivated organism
  REGION 1..1079: note = MG4-227 effector

SEQ ID NO: 646 - protein, 1059 aa, unidentified
  REGION 1..1059: note = Description of Unknown: uncultivated organism
  REGION 1..1059: note = MG4-247 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRIWFVDTREARKLKEAGYNSKLMEPLRTLNCQKVLITPLGEVRRAND

SEQ ID NO: 647 - protein, 1014 aa, unidentified
  REGION 1..1014: note = Description of Unknown: uncultivated organism with predicted taxonomy: Planctomycetes
  REGION 1..1014: note = MG4-248 effector
MKVKQESPQLILGLDIGTNSIGWSLLEDKGQDQGRIVGSGVRVYEAGMEGLIEQGKEESRNKNRRDARLHRRNLQRRARRMGGLWSLLQSSGLLPEGKAEGVLPELDKGLSETWTKKLGLDTKDKVGEKTQFSHVFPYFLRARALDEKLSCHELGRALYHLAQRRGFLSNRKAAPKKKEEEKGMKAEISELGRKIEESEARTLGEYFSRLNPEEGRIRSKHTSRKMYQEEFEAIWNAQTPHYPTILTEELKKKVSHAIFYQRPLKIRKEFIGNCEHEHNPDHPDRSPRRAPWALLDAQRFRLLQKVNDLVLTDTSTGEVRKLTPDERTKLLEALETQGDLTFGKIRKLTGLRKARFNFEAGGNDKLPGNRTASKLIKIFGEEKWKEFSTEQREQIVEDVHSIQSEEAQARRGIRAWGLEGEKAKDFGQLALEDGYCNLSRQALAKLLPRMEKGTAYKTAVKEVYGEPPAEKPLDSLPLVTEHLSSLRNPAVTRTLTELRKVVNNVVRQYGKPNMTRIELARDLKKSKKDREDIWKRNRENEKAREEAAKKILAEIPNLKPSRRDKEKVLLYEECGHKCPYTGKQISMASLLGDHPQFDIEHIIPFPRSLDDSFLNKTLCYAEENRNVKQGKTPHEAYGSNPTRWEEIIQRVKDFKGKARDIKLERFEAHGEKLDKLLGEFANRQLPDTAYASRLAVEYLGRLYGGRGGVDADGNRRVQAGRGQVTAYLRNEWGLNKILNDGGEKSRDDHRHHAVDAICVALTDAGTVKMLSDAASRATIERRRRFGKVNPPWPTFLDDVRKSIEGLIVSHRVSRKVSGPLHKGTNYSKPIRGTDKKGNPCEFRRVRKPLAELSEPEIKDVADPTIRQLVLDKLQALGVKEPKKAFSSNEANHPCLTTKDGREIPIHKVRINKKVTPFTVGEGLRQRHVTTESNHHIEVVEVLDKNGKPKWEGCLVSLKDAYDRLKAGLPVVKLDHGEGRRFVFSLAKGEAIKIDEENGGNRGLYVVKKLGDNRI

SEQ ID NO: 648 - protein, 1134 aa, unidentified
  REGION 1..1134: note = Description of Unknown: uncultivated organism with predicted taxonomy: Fuerstia marisgermanicae
  REGION 1..1134: note = MG4-249 effector
MADQLEQKPFILGIDLGTNSVGWALIRLEDGKPAGIIRAGARVFDAGMEGSAKDFESGGEKSRNLDRRRMRHQRRQTWRRARRMKKIFGLLQKFGLLPEGRCATPEDRQNFINELDRTIRASPWFQKKHPVCSKQNSELTKDEREEAHRLSQLLPYILRASALSEKLEPYILGRALYNLAQRRGFQSNRKQVAGKKEEDEEKGKVKPAIKALESKIEEQEARTLGSLLSGASPLKERIRGPQRWTGREMFRNEFDEIWKAQSHFHPELLTEDKRNELFDKDYPRHDPRVGAVFYQRPLKIQTHLVGFCELEPNLRRAPIHLLSSQRFRLLQKVNDLRIELPDSGERPLTPEERDKLVRILQDEGNQTVSDVKSKGVLNLRGCTFTLERNREKTIPGNRTAASFRKALGEKWEDMGSEERNDLVAKVYDIDDDESLKKAAVEQWHFTPQEAERLAQIKFEAKYLNLSETAVERLLPLMEIGFSYGSLAPYYSHLSSQEFLAKLFSALEEGVPHAEACRMVFGDLPVPAEAPKDVLPPVVEAFREIRNPAVTRSLTELRKVVNAIVRRYDKPAEIRIELGRELKKPKKRRELISKRNDENRSERETARREITEETGDPYPGKTDIRKVLLRRECGDQCVYCGEQFSGSNFFSDDAPIEIDHIIPRSLHWDDSFLNLALCHAKCNREKGDNTPAQVFSDEVIEQIRDRIRRFSGNEKTKRERFRRFTLAGAELSAYLEEFSRRQLQDTAYASKLAKRYLGLLYGGEIDNLGKRRVTATSGMVTWDLRGGWDLNGILNDGRTSNGSTVVKTRDDHRHHAVDAVVIALTDDRSIQQLNKAAAMGQMQGKRGIIKLPSTWNNFVDTVRAEIGRIIVSHRVSKKVSGALHEETIYSPPIAERGPDGKPNGEAVPHVRKPLFAITKGEIENIADDAVRQRVIARLEELGGGDPKKLFATEANLPFLVTRDGRHIPIKKVRVRKQLSPLVLGAGRVARHVVTEVNHHLEVFAYLDEKGNEYEWDGAVVSMAEAYRRTYSKPPLPPVQRNHGPETQYKFSLSPGEIIQCDPDNKGNSKLLVVRSVSQFETGTVQIGLAEINDARKKSDMTKDRKFIRVVPNKLRQWNARKVAVSPLGEVSEAND

SEQ ID NO: 649 - protein, 1097 aa, unidentified
  REGION 1..1097: note = Description of Unknown: uncultivated organism
  REGION 1..1097: note = MG4-250 effector
MADQLEQKPFVLGIDLGSNSVGWALIRLEDGKPAGIIRAGARAFDAGMKGSIESGREESRNVKRRQMRLQQRQTWRRARRLKKIFRLLQEFKLLPDGEASTPDKRQDLLEALDKNILASAWFKQKESAGSKHEARQVLPYLLRAAALDEKLEPHYLGRALYHLAQRRGFKSNRIQSSVKKKEDDEGPVKQEIKSLGNRMGEATLGQYFSGLSPFVQRIRTQKTLRDWYRKEFDLIWDKQAQHHPELQMTEKKKEELFHAIFDQRPLKDQSHLIGPCELEPGERRAPTYLLSSQRFRLLQKVNDLRVRVPEGSELELLAEDRTKLIQALEEKGNQTFVQVAKKLKLGEPEFNLQRGGEKKLPGDRTGSQFRKVFRKSWDQMTDEERDEKVSVVYDCLDDQKLVGIGEKEWSLDAKFAAKLTEIKFESSYLNLSRAAIGKLLTLMEAGFSYGSLAPFYRHLTPETTASLLSKVQEGMPPKLASQVVFAECINPAGEPKSLLPPVAMEIPWLRNPTVMRSLTELRKVVNAIIRQYGKKPEEIRIELAREMKKPKWRRKQISKRNRENETGRKQAKEEIKRETQNPYPSPYDIRKLILYKECRGQCVYCGAQISRSNLFGDNSDSEVDHIIPFSRLQEDSFTHVVLCHARCNAEKGNRTPSEAFTGEEHERILDRVSRFDNDEATRKAKLRHFTLAGEELANYLNDFSSRQLNDTAYASKLACQYLGVLYGGVEDSTGKKRVKASSGGVTGYLRRLWNLNRILNDGPTKSGGFIPKTRDDHRHHAVDAVVIGLTDESVVHKLSRAAERGFYRGRPFAPLEGLWPNFVPSIKTEIDRVVVSHRVSKKVSGALHEETIYSPSIPERGPDGKPNGEGIPHVRKPLAAITKGEIKDIADDAVRQRVQKRLQELGDGDPKKLFAIEANLPFLIAKDGRHIPIKRVRVKKKLPTFPLGSGRAERNVTTESNHHLEIFSKLDEDGNEVGWDGAVVSMLKVYSRKRLGLPIVQREHGPGTQFKFSLGAGEVVECDIAPGQRGLFVFRKVSRITATDQIQIGFAPLNDARKAKDMQTSRSWLWSGPNRLMERHARKFVVNPLGEVSEAHD

SEQ ID NO: 650 - protein, 1024 aa, unidentified
  REGION 1..1024: note = Description of Unknown: uncultivated organism
  REGION 1..1024: note = MG4-251 effector
MGLTTLGIDLGITSIGWGLITEDAAGIKLNGWGSRIFTPGMDDDIESGKGVSRCAQRRQKRALRIQYRRRRQRKDDLVDLLQRNDLLPTPLTPGFFIDMDKRFLMLFPVAERRVMGHLVPYLYRKKALDTKLEKFELGRTIFHLAQRRGYLSNRKQDLKDEETTGVVKAGIDALKSEMRKVGARTLGEYFCTVDPEKSRIRTRYTDRGMFQEEFRLICSAQRHLISPELEDELYKAIFFQRKLRSAKNLIGRCQIYPEERRCSYAKDEAQRFRIYSTLNHLRVAQKQQIRALTEAERAAAISVLEGFSGHLDRRGKITLAKLAKAVGLGKGEKFTLSDEEKDIHGNVLNAILYHVFGEKASSLTEKERALFFNDLNSIEKTEVLERRLRGFWQLPEDKAAEALKISLPDEYCAYSLRALHEMLPDLEAGIPLSQIRKLSYPTSTGVVYDRLPMLDGDEVDLDLRNPVVHRTLTELRAVVNAVIAKYGKPDRIRVELARDLKSSNKERERRTFEIRKREKARAEIAERIAREAQIEKPSRNDILKVMLADECNFTCPYTGKNFSMKELLYGKDIQIEHIIPYSRSFDDSFRNKTLCFSSANAKKNNRTPFEAFSGAEYEEILQRVGKFKWPFAEDKKDLFKCEKVDSEEFLARNLNDTRYASRLAVKYLGMLYGGVIDAAGKQRVFATTGGATAIVRRAWGANFLLGEGEKVRDDHRHHAIDALTIALTTPDIVKIIAGMPEELRRAKGKTPDDTIIDNAVFKQAKEMLDKAAVSHHIVNKLRGALHRETLYGKNRGGDMRHVRIGVDKLTVKDIPDIVDPVIKKLILERLEIDEDQISTITDKLLKKLVDTENPLFYRNKKGDVVNEIKAVRVKKHVTARTIGAGDGVREVANGANYLLAVFAVQDAQGNESSWEGEIVTLMDAVYRKQHDLPLFERERPGRKFKFTLKKGDIVKWNKDGVEQLCVIRGVSLPQFSCVPVCDARQQKELKNAKCWFTPTLSAAFAGKMTKYRMDILGELRRAND

SEQ ID NO: 651 - protein, 1033 aa, unidentified
  REGION 1..1033: note = Description of Unknown: uncultivated organism with predicted taxonomy: Bdellovibrio exovorus
  REGION 1..1033: note = MG4-252 effector
MRILGLDLGITSIGWALTEQPSASVTDVSEIKLVDWGSRIFEPGMAGTKNDIDTGKGVSRAVERRLARSLRHQYQRRRQRRKELIRIMTEAGFLPQELTPAFFIRMDAKLLSAFPKEDRRILGHVIPYLYRKMALNQDLSPEELGRAIYHLAQRRGYKSNRKKALKENEEEKGKVLQGIQTLKADMEAKGARTLGEYFCMLDPEEERIRGRYTERSMYEHEFHLICERQRELVSEELEKKLYKAIFFQRKLKSVKGLIGACQFEPDEKRCTFACEEAQLYRLYTSIDNLRIQKGGELRKLTDTERVAAIAILNGYSDKLDKSGKISLSALGKELHLLKGEKFTLGDEEKNIYGNALHAMLFYVFGEKSANMTPEEQSKFWHDLNSIEKEEVLQRRLASYWELNDEQVRKAMTLALPDDYCSLSLKALRTILPDLEAGIQLRKILELHYPENFRPSNNELAFLPAVDYSGIELRNPVVHRTLTELQKVVNAIIHRYGKPDYIRIELARDLKNTNKEKERITKQNREKEKERVKIIQQIIKEVGIASPTRNDILKVQLAEECGFECPYTGKHFSMAQLFDGNTIQIEHIIPFSRSFDDSYRNKTLCMATENGRKNNRTPYEAYAKEEYKAILTRVSHFKGPFRESKLQIFETKEFSPDDFLQRNLNDTRYASRLAMNYLGLLYGGAIDRNGKRRIQACSGGCTALIRRAWGANYLLGDGEKKREDHRHHAIDALTIAIITPEIVKTVANISKDEYKRRHMQNLPMLDDALYLQAEGKIDSATVSHHVVNKVRGALHNDTIYSKDGNQTYKRIRLDSISLKDIPKIRDKAIRTAVMKALGIDGDKTEAFMDSSLDPAKVFNDEHNLPWLTDKDGKNINRIKSVKVACNDKTRTIGSGDSRREVKPNDNYGLAIFAKIDANGQDKTWIYQVITLMDACQRLKKQLPIINKELQGFKFRFSLMKGDIVTITKDNHNTLCIVRAISEDEIVCTPVTDARQQKELKAAKVWFRLHPATALQLSLQKYQMNLFGDLRRAND

SEQ ID NO: 652 - protein, 1024 aa, unidentified; identical to SEQ ID NO: 650
  REGION 1..1024: note = Description of Unknown: uncultivated organism
  REGION 1..1024: note = MG4-253 effector

SEQ ID NO: 653 - protein, 1024 aa, unidentified
  REGION 1..1024: note = Description of Unknown: uncultivated organism
  REGION 1..1024: note = MG4-254 effector
MAQTTLGLDLGVASIGWALIREDGTKTTLDGWGSRIFKPGAEDDASDGKGLSLCAIRRQKKALRVQYRRRRKRKDELIRLLQENHLLPDPLTPSFFVNVDRQYLMIFPEEQRKTVGHVIPYLYRRKALDTPLSKEELGRTLYHLAQRRGYLSNRKKDLKDEEESGKVAAGIDTLKKEMEKSGARTLGEYFCLVDPEESRIRTRYTDRAMYQDEFRKICQAQRHLISAELENLLFHVIFFQNKLKSYKHLIGACSVYPEEKRCSYACEEAQIFRIYTTLNHLRIAKADQIRSLTGDEREKVFALLNGFSDLLTRKGSITLRNLGKAIGLGKGEKFTLSDDEKEIYGNVLHAILFSLFGTRAESLSQEEREKFFNDLNSIEKTEVLRRRLKSYWQLPDEKIAAAEKIPVPDDYCAYSLKALKEILPDLAEGIPLATILKLKHPMQAKDEMDQLPILDSDEADIELRNPNVHRVLTELRILINAIIVRYGKPDRIRIELARDLKSSAKERERRMWEMRQREKERTAIAGKIAEEAGIENPSRNDILKVMLAEECGYECPYTGKHFSMRDLLHGKDIHIEHIIPYSRSFDDSYRNKTLCLASANAAKNNRTPFEAFSGKEYQDILQRVARFRGPFAEAKLALFKLEKVEPEEFLERNLNDTRYASRLAMQYLALLYGGIIDKTGKQRIFATSGSCTAMIRRAWGGNYLLGEGEKVRDDHRHHAIDALTIALTTPEMIKVIASMTREERSRKQKSCNDTIIDNEIFRQASADLDNIPVSHHVVNKIRGALHDENPCGKDYGEQIRHKRIELSKLKADSVLKIVDRTVKNIILKRIGCSEKELAGLSEKEFAKRLDAGTPLLFKDKEGGTVNVIKKVRIKAKVTAKTIGSGDSLRNVANGSNYLLAIFAVLDEQGNETAWEGEIVSLMDARYRLTHKMPLFEKDRPGRKFKFTLKKGDIVKFRKDGTEYLCIIRGVSLPQFSCCPVKDARMQRDLKAAKVWFTPTVSAAFQGTMTKYRMNIFGELQRAND

SEQ ID NO: 654 - protein, 1024 aa, unidentified; identical to SEQ ID NO: 650
  REGION 1..1024: note = Description of Unknown: uncultivated organism
  REGION 1..1024: note = MG4-255 effector

SEQ ID NO: 655 - protein, 1024 aa, unidentified; identical to SEQ ID NO: 650
  REGION 1..1024: note = Description of Unknown: uncultivated organism
  REGION 1..1024: note = MG4-256 effector

SEQ ID NO: 656 - protein, 974 aa, unidentified
  REGION 1..974: note = Description of Unknown: uncultivated organism with predicted taxonomy: Planctomycetes
  REGION 1..974: note = MG4-257 effector
VESTGLILGLDIGVRSVGWALLDLKAKEIKGLGVRVFDAGVEGNVERGRDTSKAAARREARLRRRQTERQVRKQVKLAHILQDAGLLPEGKVSKPTERHQLLSVLDRQIGESYSSADRGKLPYILRAAALHVALEPFELGRALYHLAQRRGYKSNRKSDAKVDEKQGKVKPAIHELEKKIISVGAETLGEYLAMQDSPKVALRGPGQYTSRDMYLAEFEAIWSEQAKYYPALLTEKLKANVSDAIFFQRPLKSQAHLVGKCQLETGEKRAPWALPIAQRYRMLQTVNSLKVLAADGKARELSASERAKLLEKLECSKKQSFDEIRKCLKLGDDCSFNLEQLGRKEIPGNKTAALLATAFTKKRWASIPEKDKQRIYAVFNSEEDEDKLILIAQDEWKLDEKQARKIAGVSAEAGYCRFSEKALFRLIPYLEAGSDLESAIHKEYPGSRVASEKRDILPPVLSTVQLRSPAVTRALTEVRKVVNAIVHEYGLPETIRIELARDIKRNREERQNINKKISERTKEREAARTRLQEDFNLADPKSSDIEKYLLWQESGPKCPYCGNPIAGEVLFSGATHIDHIIPRKVSLDNSFVNKVLCCSKCNNDKSDRTPHEAFNGDTQRWEKIAERVGAFRSEYRREKLRRVLMTKKEAQEFYTGFTDSQLNDTKFASREAGDYLGLLYGGRVDADGNTRVQMTKGGITSELRNALQLGSIPSQVEDWICDPEEKRGKDRGDHRHHAIDAIAIALSSPGIIKPLMGAYSSSETAKKEMRRDIWASFAKKAAWPGFSDNVVEAVNSISISRRPKHRVRGKLFDENPLSEKGAARKSGDISEAYIRIGKDEAHSRLLKSAGNHHIEIYETKDAKGRPEWKGKAVTLYEAHNRIIDDEPVVNRHHGPNTRFLFSLAVGDTIELGEKQERKLYNVCSVWEDEPGSCRIEYKPLNSATTDRGVNARLNPIRKLKCKKVEVSPLGEHGS

SEQ ID NO: 657 - protein, 831 aa, unidentified
  REGION 1..831: note = Description of Unknown: uncultivated organism
  REGION 1..831: note = MG4-258 effector
MHSYVLGLDLGSASIGWAILEPNKKVIDCGVRIFDPGVNLEMFNKGQEGSSNNLVRRMARLHRRQLRRRAARQRDLFELLQQHSLLPGNATRDSQQRHDILQHLDSDLRAAWMNRLTAAGVPEQSLIYLVRKQALDAPLEPYEVGRVLYQLAQRRGFKSNRREQAAVEAAEGSKKKSVRAKDEASVVKDGIKELRAEMEAAGARTLGEHFANLSTSGQTIRRHWTDRKWFEAEFEAIWQAQAPHHAALIPELKQQVFQLLFFQRPIATNAHLIGKCELEPTERRAPMANLLAQRFRYLQKLNDLAIDDPLNPQRLTEEQRAVLLSAFECKPDLTFDAIRKLLSFDKAVRFNLERGGEKKLPGNRTNAAMLRAIPDLWPTLSDADKGAIVEQWIDANDDEDLIARLTTHCALSLDDATAICKVHPEDRYHNVSLLAMSRLLPLMEQGVAFKTAENEIYGTRFSGGKPLDLLPPAKDVLASIPNPAVMRALSELRKVVNAIVQKHGKPGQVRIELARDLKRNAKQREMNWRRGRDRETVRTAAVKRILDEAHRPQPWKQDVDRVLLLEECRDLCVYCGQAISFQRLFDGDIDIDHILPRNRFPDDSFANRCLAHRACNQLKLGRTPYEAFGSDEELWPNIIARVKTWDNPDKLERFNLRDDGEFDPEREDSFAARRLNDTRYVSKLAARYVGMLYGGRDVPQPDGAAKRVVFASTGMLTASLRRTWGLEAILREPEPAETSRKPGKQRTDNRHHAIDAIVIALTSNAVIQKASSVAATGSYGDAARAISRVQPPWGDFVGDFVDSIRPAIERMVVSHRPSHKLLGALHEETNY

SEQ ID NO: 658 - protein, 1073 aa, unidentified
  REGION 1..1073: note = Description of Unknown: uncultivated organism with predicted taxonomy: Acidobacteria
  REGION 1..1073: note = MG4-259 effector
MPLRADLPPYVLGLDLGSASLGWALIAIDHQHNPTALIRAGVRIFQPGVEGSAFDIERGKDKSRAADRRTARLHRRQLRRRAARQRDLFNLLQAHALLPGASDGASSSERRHTLLNELDKQLTDCLLRTAADDALAANRIADSLPYQLRKAALDRRLEPHELGRVLYHLIQRRGFKSNRREGKKSKDKQEEQGKVKAGISELQQKIAAAGARTLGEYFAGLDPHQQKIRRLWTARSMFEEEFEQIWRTQEAYAPDLLTQDLKSQIGYLLFYQRPIASQEHLIGRCELEPGEPRAPWATLEAQEFRVLQKVNDLAIVIPGSLHDQSLTREQREKVYLALQDTGDQKFSALRKLFELPRVQFNLERGGEKTLRGNRTHAHMFSVFGARWNEFSTDEKKRAVQVWRTAEDPGDLIAKGMEEFGLEEALARRWADVEPEDGYCSLSLKAIGELLPQMREGVSFKTVEREKYGEPFSGQEPQELLPRIREALPTLRNPAVERAVTEMRNVVNAIIREYGKPYEIRLEMARELRKSRKERENVTKRNRSRERERQQAKARILQECGLQNPSRADIEKALLFEECGGVCPYTGRTIEFSSLFRDSQFDVEHIIPLSRYPDDSFLNKTLCYHEENRSVKRGRTPWEAYGPDSERWDAILSRVQGFNNPAKLTRFKLRTEEELGEFTQRQMNDTRYTTRLAADLLGSLYGGRDETLPDGAKRRAIFATTGQVTATLRRVWNLESILREALPSANGESKGKPRTDHRHHAIDAIVVALTSQRTVQLLSMAAAQSVAGESRSRVFTGIQSPWPNFVDSIRPHIEQMIVSHRPEHKMSGELHDETNYGRPYRDGKKTYVHIRKPIASLSTKDIQAIVDPIVRTAVQKKAEALGGDLSKCEVSQNWPVMPTNKERAVPIRSTRIRKVLDVTAIGEGPRQRFVAESSNHHVEVFASLDAQGRESKWESITVSLLEASERNRKKQKVVQRLYPESEDYTFKFSLMGGDSVDLHRNCDHNLGRCNPALYRVRTIAANGQLSLVKITDARLKQDIQKVSEWWSPMCNALRKLDCRKVVVDLLGRVHPAND

SEQ ID NO: 659 - protein, 815 aa, unidentified
  REGION 1..815: note = Description of Unknown: uncultivated organism with predicted taxonomy: Planctomycetes bacterium
  REGION 1..815: note = MG4-260 effector
KHLLFYQRPIKAQSHLIGGCELEPGERRAPWASLEAQQFRILQKVNDLETILPGNVTGIRLTPEQRKTVLNLLENSPEATFKKIRKALDLAENIGFNLQRGGETRLKGNLTNARMAEAFSDRWPTMSDEEKKQVVEDWRTIEQNESFMRRAIEYWKLDEAGADWLADQSAPQGYCSISRKAIRRLLPLMMEGKRFKEAETEVYGNRLTGGKVYDRIPPVRDVLRTLRNPAVERSLTELRKVVNALVREHGKPAEVRIELARDLKKPRHERAEAITKNRNREKERVAAKTKLLQELGPGFEHPSRADVEKALLHEECGGVCPYTGRHIEFASLFGENPQFDVEHIIPFSRIPDDSFQNKTLCYHEENRLVKRNMTPFEVYKDPAQYEAILNRVRTWKKLNPGKQRRFELRTLEELEGFSARQLNDTRYASKLACELVGSLFGGRDAQTENGSRQIVFASSGMVTATLRKGWGLEAILREAAPSANGQNRGKPRTDHRHHAIDAITIALSRPKMIATLSRNNAQDPYWPQNGRTAPRIQSPWKDFVGSIRPHFEQMLVSHRPEHRLTGALHDETNYGRPRKDGSKDVVHIRKQVAGLSAGDIENIVDPAVRDAVCTKAREFGGDLKKWTPNEDKEDWPLLVTRTGKPIPIKRVRIKKALRVETIAKGERVRHVALSSNHHVAIFALLDERGREKRWESEIVSLLTAMERKRNRQPVIRTRLPEVPEAAFKFSLMWGDILLLHKDCEHSKNICNPSFWRIRSIWEQGTLTLVRINDARLLTEIRAAKDWLLPSPDTLRKLGAVKVVIDSLGRIHQAGG

SEQ ID NO: 660 - protein, 911 aa, unidentified
  REGION 1..911: note = Description of Unknown: uncultivated organism
  REGION 1..911: note = MG4-261 effector
NRIGHVLPYLLRKTALDRPLDKYDLGRALYHLAQRRGYLSNRKQELKDSEDFGVVKSKINELRQAMTSSGARTLGEYFSMVNPEEERIRCRYTDRAMYQDEFRKICNAQRQHISEALETELFQVIFFQRKLKSCKHLIGKCQVYPEQKRCSLCHPEAQLFRICTTVNNLRISCDSQIRSLTDDERLRVTEVLNGFSDLFNKSGKITLAKLKQATGLLSSEKFTFGDDEKEIYGNELHNILYRAFGSEAALMSQEKQSCFINDLRSIEKNEVLKKRLTEYWQLSEEKASEVATIKLPDDYCAYSLKALKQMLPDLQAGVNLADWLKCNNHSTESYIELDQLPLVDECGFELRNPVVHRVLTELRRVVNSIISRYGKPDLIHIELARDLKASNKEREQITKRNQQRERERNAIAERIIKETGLEKISRKDILKVMLADECDFTCPYSGKRFSMTELLNGGLVEVEHIIPFSRSFDDSFANKTLCVRELNAKKNNRTPFEAFGGSPQYSEMLTRVKYFKGHFAEHKLNLFKLAEIESSGFLERNLNDTRYASKLSMRYLAFLYGGIVDKNSIRRIFSVAGGCTALIRRAWGGNYLLGEGEKVRDDHRHHAIDAVTVALTTPELVQKIAKLSQEGRRKLNDSTKNFIDNDFYYQAQGMMDSCAVSHHQTNKMRGALHEETIYSKDYGDGQSIRHKRIALDQLSPKDIENIVDPAVKTIILKALKVSAPGDVTKATLKIFKDEANYPQMLDHNGNAVNTIKKVRIARTVNTRTIGKGDGKREVANGANYILAIFAKLNEKGEETGWEGEVVSLMDAVQRKQRRQEIFSKERPGMKFKFSLQKGDIVKINKNGEEKLCRIRGISLPQFYCCQISDARTQNDLKSAGCWYTPTVSAAFNWKMQKYNMNIFGELQTAND

SEQ ID NO: 661 - protein, 1002 aa, unidentified
  REGION 1..1002: note = Description of Unknown: uncultivated organism with predicted taxonomy: Planctomycetes
  REGION 1..1002: note = MG6-7 effector
MSEITLGLDIGSNSIGWALLNLDENPSIINVGVRVFQEGVNRDTKGAEISKNETRRMARGARRNRFRRNYRKDKLLRLMKRNGLLPKEASTNGEIFLLNPYQLRAKGLDEKLSLHEFGRVLYHLNQRRGFLSNRKSGKAKDDGIVIKSAGELQQKMDAQGARTLGEYFSRIDITQERIRDNYTFRGMYQKEFDLLWEKQSSFYPEILTPELRQTIADETIFYQRPLKPTDELIGDCALEPDHKRCPRGDWHARRFRILQDVNNLMVCEPDGRKRILTEQERSIALKELFGRKEVGFDSLRKKLGLIENQTFNFEEGSLDKKESKLKGDFFASEMSSKKILGKKGWEALDIATQIEINDLLLDDNLADEEVVEMLKQQYGFSDEQAEAAIKISLPRGYMTYSRLAIQKLLPHLERELRTDEAVQAAYGHIHSVQDTGQTVDFLPLPEDLRNPIVNKALIEARKVINAVIQTYGKPGKIVVEMARDVKGNAKEREELRIKMNRNEKENERARHELIHNMGITRPTRDDILKYKLWQECGRECPYTGRPISQQALFGEHPEFQIEHIIPYSRCLDDSFMNKTLCYVDENRRKGDQTPYEFYKNSDQYEHMLQRIRKLPYPKRQKFTQKEVSLDEFIKRQLNDTRYITREILRYLKQLGCTVTGSRGKVTSELRHQWGLNSILESDLPGPKNREDHRHHAIDAVVTALTNQKHLHELAATKYAVAHDGFPVPWEGFRDAVAQAVNKIQVSHRVTRKVSGPLHEETSYGPTGLKDDKGQDIFVYRKKLEALTCPMVEKIVDPVVKEVVKTRLLEFGIDPKKKGSIPKEVWAEPLYMKSTKSAKVPIKKVRIRDVFNNMIPVNDEIGKPYRYVASGNNHHIEIFEYTDAKGNLKRNGKVISMFEAVQRSRQGKPVIYRDYGDGKRFVCSLAKNEMFMLEVEEGRHILHRVQKFGEVGGTIIIVLRPHTFAGKVNDSDKPPYIQRKTPNTLKGYKVTIDPLGRIFPAKD

SEQ ID NO: 662 - protein, 994 aa, unidentified
  REGION 1..994: note = Description of Unknown: uncultivated organism with predicted taxonomy: Planctomycetes bacterium
  REGION 1..994: note = MG6-8 effector
MSDYTLGLDMGSNSIGWALLDTNNRAVVDAGVRVFQEGVDRDTKGAEVSKNETRRTARSARRARKRRNYRKDKLFRMLIRHGLLPKGPDELKEVFELDPYLLRAKGLDEKLDAYEFGRVLYHLNQRRGFWSNRKSGKSKEDGVVVKSATALAEAMDESRSRTIGEYFAGVDSHEKRIRGHYTFRSMYEEEFEALWTKQASFDGELFTDGLKKAIKDETIFFQRPLRWDPETIGDCELEPGEKRCPRADWHARRFRILQTVNNLKLYNPDGREGDLSKYRETIIGELCNRKEVYFDSLRRKLGLIDSQTFNFEEGAAEKKAKLKGDEFVPQLKKAIGAKALKGLEEADIIEINDALIDDNIEDEELVEKLMEQYGFSEEQANGVVNISLPSKYTNFSRLALQKLLPKMEAGLRTDEAIEAVYGKRQAVGEIEKRRRLGSVPDLRNPIVMKALWEVRKVVNGLVREYGIPRKIKIEMARDVKGSVKERDEIRVKQWKNEQENKRAEEELKLMGIRNPSFNDRLKYKLWEECGKECPYTGKPISQHQLFGEHPDIQIEHILPYSRTLDDSYMNKTLCYVNENRLKGNETPYEYYAENRVEQWEEILQRIKVLPYAKRRRFWQKEVVLDNFIQRQLNDTRYISREVVKYLKQLGCIVTGTKGQITSELRHQWGLNNILDYTGAGLKNRDDHRHHAVDAVVTAVTEQKHLGGLAASKYDKSGIEFDPPWEGFREQVAEKINAINVSHRVTRKVSGQLHEETSYGPTGLKDDKGQDIFVYRKPLEALTLPMAAKIVDPVVREIVYERLREFGIDPDGKSKIGKEVWKEPLYMKSKSGKGPQIKKVRIRDVFNNMIYIKDDAGKEYRAVAPGNNHHIEIFEYANKKGRIKRDGKVVTMYEAVRRSVNNKQVIRRDYMDDKKFVCSLSKNEMFMLEVEDGVHVLHRVQKLIQDGRIVLRPHTYAGKVSDSDNPPLVQRKNYNTLRGYKVTVDPIGRIHRAND

SEQ ID NO: 663 - protein, 896 aa, unidentified
  REGION 1..896: note = Description of Unknown: uncultivated organism
  REGION 1..896: note = MG6-9 effector
LNEKLELFEFGRAIYHINQRRGFKSNRKTGKAKEDGKVAKAAGELQKKIEANGCRTLGEYFASINPEEERIREQYTFRTMYEEEFDKLWNRQAEFYKNVLNGDLHKKIRDEIIFYQRPLKPTDDLIGDCELEAGEKRCPRGDWYARRFRLLQDVNNLKVYNPDGTARELEDDESGIILKKLATHKEVKFSSLRKELGLLKTQEFNAEYQIDNKGKKQEKLKGDAFNASMRSKNIFGAKTWDAMDEAEKIKLNEWLVDLDDDELIEKLSSEYGLRDEQIDRVLKISLPQRYMNFSRKAIQKLLSLMEKGKRTDEALAEIYPDRNKRAKGEEKDRLDLPDDLRNPLVNRGLFEVRKLVNAVIREHGKPSGIVIEMARDVKGSLKEREEIQWKMRENEKRNEAARTRLIQDMDILNPSRDDVIKYKLWEECGKRCPYTGKVISLTDLFGSNPVFQVEHILPYSRSLDDSYMNKTLCCVNENRIKGNKTPYEFYSGDEEKYEQVKQQIKVLPWPKRRRFLQKEIKLDECIQREMNDTRYICKEVVKYLKQLGVNVRGSKGRVTAELRHQWGLNSILDLNNSNMKNRDDHRHHAIDAVVTAVTKNEHLRRLAKSKYSKTDSSFSEPWEDFREELAEKVKHINVSHRVRRKVSGKLHEDTSYGLTGAKDDKGQEIFVYRKKIEDLTIPMVSKIADHVVRQIIESRLKKHGIDLDKNQTIPKDVWTKPLYMKNTKSNKKVLIKKVRIRDAFNNMIFLKDKEGKTYRAVAPGSNHHIEIFEYTDKKGKMMRGGEIVTMFEAVKRKREDQPVIKRECGADKKFICSLAMNEMFMLDTNNKEKELHRVQKITQSGNSISIILRPHSYAGKVSDYDKPPIIQRRSPNTLKGHKVTVDMLGRVHLAND

SEQ ID NO: 664 - protein, 996 aa, unidentified
  REGION 1..996: note = Description of Unknown: uncultivated organism with predicted taxonomy: Planctomycetes bacterium
  REGION 1..996: note = MG6-10 effector
MSKYTLGLDIGSNSIGWALLDTGKSPKIIDLGVRVFPEGVDRDTKGAELSKNATRREARGARRNRWRRAYRKDKLVRMLQREGLLPREFDLIQKLMETNPYLLRAKGLDEQLGLHDFGRVLFHINQRRGFKSNRKTGKASDNNKVAKEAGQLQEAIDNTGCRTLGEYYANLNPEKNRIRSQYTFRSMYEKEFALLWAKQSEFYPEILTEQLKEEIKDKTVFYQRPLKPTDDLIGECDLEEGEKRCPRGDWYARKFRLLQDVNNLKIHHSDGSEDPLTDEQRAIVLEQLKKSKAVKFSSLRKKLGLLETDEFNMEYEVNEKGKKKDKIQGDEFNASMQKNIFGLKRWGEMAEGEKIRLNEWLVDLEDDELIEKLASEYGFSDEQTEKVLKISLPSRYMSFSQKAIKKLLPLMEEGKRTDEALDKIYPDRNQKKQVEAERLGLPEDLRNPLVNKALFEVRKVVNAVIREYGKPAKIAIEMARDLKGSLRERKEIHFKQKENERENKRVRERLKNDFNHVSLNRDNIIKYKLWEECNGLCPYTGKKIPQYALFGENPEFQIEHILPYSRSLDDSYMNKTLCEVHENISVKGNQTPYEAYHHDEEKYEQIKQRIKVLPWPKRRKFLQKEIELDEAITRELNDTRYICREAVRYLKQICSNVKGTRGKITSELRHQWGLNSILNLTDPNMKNRDDHRHHAIDAAVVAVTRNKHLRELAESKYAKTGSGVKFEAPWKDFREELAEKIKHINVSHRVTRKVSGQLHEETAYGPTGLKDDKGQDIFVYRKKLEDFTMPMVGRIVDPVVKEIVVDRLKKHGLNPEKKQTIPKEVWREPLYMKSKTGNGPRIKKVRIRDVFNNMIMLKDQNGKPYRAVAPGNNHHIEIFEYKDKDGNIKRDSKVVSMFEAVRRRRKGEPVIQRDHGEGKKFICSLSTNEMVMMPDKEGNNDLFRVQKMSINKQIYFRHHTAATIDNEETLIRKQANLFNGKKVAVDPIGRVFPAND

SEQ ID NO: 665 - protein, 994 aa, unidentified; identical to SEQ ID NO: 662
  REGION 1..994: note = Description of Unknown: uncultivated organism with predicted taxonomy: Planctomycetes bacterium
  REGION 1..994: note = MG6-11 effector

SEQ ID NO: 666 - protein, 896 aa, unidentified; identical to SEQ ID NO: 663
  REGION 1..896: note = Description of Unknown: uncultivated organism
  REGION 1..896: note = MG6-12 effector

SEQ ID NO: 667 - protein, 996 aa, unidentified; identical to SEQ ID NO: 664
  REGION 1..996: note = Description of Unknown: uncultivated organism with predicted taxonomy: Planctomycetes bacterium
  REGION 1..996: note = MG6-13 effector

SEQ ID NO: 668 - protein, 1063 aa, unidentified
  REGION 1..1063: note = Description of Unknown: uncultivated organism
  REGION 1..1063: note = MG6-20 effector
EAFDEANPYTLRKMALYGPLTSEQFGRVLFQQGKRRGLKSNRKAERKADDGDVNRATKRLEAKIADDDCQTLGERLYRIGAGQIADSQNVKPGDLNPHRIRGRYTLRKMYEEEFEKLWNKQEQHIPELRAEGLKSRIRRIIFDQRALRSSKHLIGRCECTGQRRAAKADWYAQEFRLLKDLNHLRIHNSDGSEQDLKKEQRLRLAELLRCTDRLTFDEMRQELGLIDSQIFNLEEGPSATVGQTNEGKKSKVRAGAKRKSLAGNSIESALWKAFGKNWALQTEVRKDEIRQAIVEIEDEEKLMRLAVGLWGLKRTQAEALAKLHLPEGYAKYSLDALKNLVAELRKGLKSERGIAEYEARERCGYNSPVTQSLLDFLPSPVKPDRRPLVNNPIVRQSLFEVRKVVNAIIRQYGRPKRVVVEMIREIKGSLRQRAEIRDQQEASRKDREEIRTMLRDPIEFGKDNPSNDDILAYRLWEQQGHLSPYSGKTICQTDLRRFLNGEGVLEIDHILPYSKSWDNSQSNKCLCFSDENKNKKDFTPRQWLGDGTDAYTSMLQYVAGMKTTGMPFSKRRKFSQLEVDPEDCAKRQLNDTAYIAREVRQYLKCLYSEEELVRDESVVCTRGQVTSDLCWCWELNSILNPDDQRETKNRADLRHHAIDAIVVALTTRQRLFALSQVFAKKHSLAKAKHEPWPHFREDVENAVLAIKVSHRPRKRVSGPLHNDTIYGATDEDGRFVSRKFLTDLTPTMVSRIRDARVREAVVERLRKHGIKAKGADSIRDVGPEETPGDSDKRIPKKIWEEPLILVRKDCTEGPRPTPIMKVRLIGPEKTIRPIRNGAALVKPASTHHLSLFEIRKSNGDPEWIAHFVHLIDAAQIVGERQRRFSMIRKQLGAARLPSSEIKRRLELEQCRLDIELPLIVKTHPDIPSARFLFSLSKGEMLLLSIKGKEQLYRFETAASTTEQMWFLKHNEAAIPKNKRLSKKPDNLRGLKPRKVILDPLGRDVSGTGKVYDRVDSKVGDLAKEIIANGMSNSRGHKLLKQMGLGQLGAQLTAELRRLRSGGL

SEQ ID NO: 669 - protein, 1121 aa, unidentified
  REGION 1..1121: note = Description of Unknown: uncultivated organism with predicted taxonomy: Arcicella aurantiaca
  REGION 1..1121: note = MG7-2 effector
MKKIVGLDIGVSSIGWSYVLESEIETDEETEDIIELGSRIIPLSNDDADQFSKGQSITKNKERTQKRTARKTNNRYKLRKHKLGEVLKNQEIIINPELFDLTAYELYALRVRAIHEPITLAELARLWYQFNQKRGYQSLRGVVDEEADKKSDYLSSINDRSQFLKDNKQTVGQFLFNRLKDYEQNRGVIEPITHIIFNRQDYFNEFNLIWERQKMEYPEVLTDELLANIRDRIIFYQRPLMSQKHLVSDCTFEKNHKAAPKSSPLFQVFKIWQDLNHFEIKTKRGAIVAFTVEMKQKVFEVLDNQFDINKTKFWEILELKASEHRLNFKEIRGNVSKAKLVEAFAELDINRPDLLSFDPHGDPDEQPLFRIWHLLYSINEKNADEILLRTLQNTPYNFSEKEAIGLIQKVSFKNDFGSLSSRAMRKILPHLEQGLNYADACLEVGNRHSHYRTKEENNERVLADKLLPLPKNSLRQPVVEKIVNQVINVMNAILADSNLGRPDEIRIELARELKQNIKQRERTERNNNKRQKARKDVVKEILKTFPDMKEKDVTNRMIQKYELFQETNGICVYTGTEMKLGAVLSGQGFDIEHIIPKSRRFDDSFMNKTLADSSTNRDKNDLTAYDFMRKKGMTSFEKFTEIIHKLHKDKKISDTKLDNLLTTLNPVWIAEQEAKALSTDFINRQLNETQYITKQVKAELDKICRTITVTSGGITDYLRHQWGVDDVLKNINLEKYEAAGKVSDEDYRDRQGHWRTRKKIADWSKRDDHRHHAIDALVIACTKPAYIKRLNDLNQEYDSYKEMKKDGGKMESLTKFPQPKMKGGFIQNVTKATENILISFKAGKKAVSTSKNKKTGQVNIIPRGQLHEETVYGQKFDESGKPYFVIRKKLEFNKQGYFNSLAQIDKIEDEIIKKKVLKRIDEYGGDLQKALSTVIYHNEDQKIPIKKVMIQAQIKKAVPLGNHEGKFVAEGNNHHLALYRNEKGKYLTELVSVWTAVVRKQNDLDIICRNHPEGLKFITCFQQNEMFIYELSPEQVQEAIDRKDRKLLSKYLYRMQKISKKESGGIEVGFRHHLETKIDDSETAKKIKKFFIVQGVETLLKFTKVKINHLGQITKIFAEGE

SEQ ID NO: 670 - protein, 781 aa, unidentified
  REGION 1..781: note = Description of Unknown: uncultivated organism with predicted taxonomy: Flavobacteriales
  REGION 1..781: note = MG7-5 effector
MKKIVGLDIGVSSIGWSYVLESEIETDEETEDVIAMGSRIIPLSQKDTDEFSKGDSITKHKARTQKRTARKTNNRYKLRKHQLGEVLNNQGIIINPELFGLTARELYALRVRAVHEPITLSELARLWYQFNQKRGYQSLRGVVDEEADKKSDYLSSINERSQFLKDNKQTVGQFLFNRLQDYEQNRGVIEPITHIIFNRQDYFNEFNQIWERQKLEYPEILTDELLANIRDRIIFYQRPLMSQKHLVSDCTFEKNHKAAPKSSPLFQVFKIWKDLNHFEIKTKRGAIVEFTVEMKQKVFGVLDNQFDINKTKLWEILGLKASEHRLNFKEIRGNVTKAKLVEAFTELNINRPDLLSFDPHGNPDEQPLFRIWHLLYSINEKNADEILLKTLQNAPYSFTEKEAIGLIQKVSFKNDFGSLSSRAMRKILPHLEQGLPYDKACLEVGIRHSHYRTKEENNERILADKLLPLPKNSLRQPVVEKIVNQVINVMNAILADPNLGRPDEIRIELARELKQNIKQRERTESNNNKRQKARKDVVKEILKTFPDMKEKEVTQRMIQKYELFQETNGICVYTGTEMKLGAVLAGQGYDIEHIIPKSRRFDDSFMNKTLADSSTNRDKNDLTAYDFMRNKGMTAFEKFTEIIHTLHKNKKISDAKLDNLLTTLNPVWIAEKEAKELSTDFISRQLKETQYITKQVKAELDKICRKITVTSGGITDYLRHQWGVDDVLKNINLEKYEAAGKVHDEEYRDRQGHWRTRKKIADWSKREDHRHHAIDALGIAC

SEQ ID NO: 671 - protein, 774 aa, unidentified
  REGION 1..774: note = Description of Unknown: uncultivated organism with predicted taxonomy: Arcicella aurantiaca
  REGION 1..774: note = MG7-6 effector
MKKIVGLDIGVSSIGCSYVLESKIETDEEIEDVIAMGSRIIPLSKEDTDEFSKGQTITKHKARTQKRTARKTNNRYKLRKHQLGEVLNNQGIIINPELFGLTARELYALRVRAIHEPVTLSELARLWYQFNQKRGYQSLRGVVDEEADKKSDYLSSINERSQFLKDNKQTVGQFLFNRLQDYEQNRGVIEPITHIIFNRQDYFNEFNQIWERQKTEYPDILTDELLANIRDRIIFYQRPLMSQKHLVSDCTFEKNHKAAPKSSPLFQVFKIWQDLNHFEIKTKRGAIVDFTVEMKQKVFEILDNQFDINKTKFWEILGLKASEHRLNFKEIRGNVTKAKLVEAFSELNINRPDLLLFDPHGDPDEQPLFRIWHLLYSINEKNADEILLKTLQNAPYSFTEKEAIGLIQKVSFKNDFGSLSSRAMRKILSHLEKSLNYADACLEVGNRHSHYRTKEENDERILADKLLPLPKNSLRQPVVEKIVNQVINVMNAILADPNLGRPNEIRIELARELKQNIKQRERTESNNNKRQKARKDVVKEILKTFPDMKEKEVTQRMIQKYELFQETNGICIYTGTEMKLGAVLSGQGYDIEHIIPKSRRFDDSFMNKTLADSSTNRDKNDLTAYDFMRNKGTTAFEKFTEIIHKLHKDKKISDTKLDNLLTTLNPVWIAEQEAKALSTDFISRQLNETQYITKQVKAELDKICKKITVTSGGITDYLRHQWGVDDVLKNINLEKYEAAEKVHDEEYRDRQGHWRTRKKIADWSKRDDHRHHAI

SEQ ID NO: 672 - protein, 1131 aa, unidentified
  REGION 1..1131: note = Description of Unknown: uncultivated organism
  REGION 1..1131: note = MG7-9 effector
MKKVLGLDLGIASIGWALIAQNSENEEISHIIDCGVRVVPLSTDEHSEFAKGGSVPTNQIRRRARGMRRNLQRYRWRRHRLYCVLGQLGMMPDQRLMTRLSPLELYSLRSRALSEPLSLQEIGRILIHLNNWRGYRSNRREAVKDDEKSRYLKEIKNNEDQLKVEDKTIGQFFAERLHQGDRQRIRGRIFGRNTYIDEFNRIWDAQAQYHPSVLTEEHRRLIRDRIIYYQRPLKSAKGLVGTCALEWYYALYKETRQPKYENGRKKIVRPKCAPKSSPLNQECKVWESIHNLRIYRRDRNGRRESQPIALTLEQKKHLFWYLQESKKNLKAEEALRLLGFSAGAYAVDDHTLENNRTLSRLKEVFKKLGIRRDDLLRFDPAIEEVEWDDLETGERRRRLQVRGDFDREPLYQLWHLIYATEDEGDLIQLLEERYGFTTEQAREIAKIDFTSEGYARKSHRALRRLLPHYREGLDYTKACEAAGYRHADYITKAENEARILSERLELLPKNALRNPVVEKILNQMVHLVNDLMTTYGRPDEVRVELARELKQSAQERKKTHELNQKRRRENERIKKDIADHLAIPPEKVTRAQIEKYRFYKEIDGISLYTGKRFSLADVLNGDTVDVEHIIPRTLRFDDSYHNKTLCERNINQEKGNMTACDYMRSRGAQEYEAYLERVKAFYEKNGREVRLKYKNLTTTQEDLLKDNEFLQRQLRESQYIARKAVEVLREVCRNVYTTTGSITDFLRHRWGWDEVIPYLRLPQFKEAGLTEIIPVQNGQKTKEVIKGWSKRDDHRHHALDALVVACTRQSHIQRINELSPILAGTYGEERRQQLLDIVRDKYIAGKIPFSFRQVCEAMNQVLVSHKQRTRVATRNCPKGSQKVQITLTPRGRLHEETIYGRIRRYKKVSLDGKFSVAMLDDMVHPHQRELVEARLAQYANNPKAAFKDLDKNPIRYGPNGEKHLREVTVWEYIMVSRKALDPKATGKALKGIIDPVVHQVVKQHFEAGNVGGLPFRHVRVENRAEEWIRLPRGYAEPGSNHHIAIYRDADGKKHEHVVTFWEAFQRVHIGLPPIITDVAGALEYLSHLPGELPELHLPENPDWQFVVSLARNDMFVFGLDPADIDLRDLKN

SEQ ID NO: 673 - protein, 1225 aa, unidentified
  REGION 1..1225: note = Description of Unknown: uncultivated organism with predicted taxonomy: Bacteroidetes
  REGION 1..1225: note = MG7-10 effector
MEKVLGLDLGVSSIGWAMTLQDPNNEERSEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDGEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLAQNDMFVFDLDPSEINFTDPNNRARISKHLFKVRKLSANDYSFLHHLETEIVDDLVSKSINRCKRCSMSALSRSRAVKVKINRLGHVVEVGQPFS

SEQ ID NO: 674 - protein, 1218 aa, unidentified
  REGION 1..1218: note = Description of Unknown: uncultivated organism with predicted taxonomy: Bacteroidetes
  REGION 1..1218: note = MG7-11 effector
MKKVLGLDIGVNSIGWAYIAEPENKNEKYNILGAGSRIIPLNSDETSEFKSGNAISKNSARRIKRGIRRGGHRYKMRKWKLTAKLKELGMFPDKELFSLHSLELYSLRTKAISEKISLQEIGRIFYHLNQKRGYKSNRKANNDENIEVNVSDKPGKKKGYLDLINDRENILTSQKITIGQYFYYKLKEQPFFRIKDNIFTRKSYQQEFKKIWDQQSIYYPNILTEEAFNILFNEIIYFQRPLKSQKHLVTDCRFEFVFAKNNKGELLKDDTGSLRKIKLKAAPKSSPLFQLAKVWQDINNLKIQDTYGNIIEITLEKKKLIADKLQETDKITLKELKKILGLSSKEEYYYNLKKEYIEGNRTFVQLKKILGDNPLLEFNVEINERSISDYNTGETEVRKVINSSIEQSPLYQLWHLLFAAEENENLISTLCKKYSLSPETALALSKLDMTKAGYGALSTKAYRKILPYLMEGSGYSDACQLAGYRHSDYLSKEENESRQLLAKLDLYPINSLRNPVVEKVINQVINLVNAILEDPAYGRPDEIRVELGRELKQNAEERNKTFSRNKKEDAKHKDIIHRLMTECNFKKVSRRDIERYKLWEEFGYVSPYEPSKPISLSELFSGAYEVEHIIPKSRLFDDSFANKTICPRPINAAKDNQTAFDYMSGLGQQKLDEFTDFIQKHKTKKDGISQTKAKYLLCKGSEIPQDFINRQMRETAYISREVKNLLLGICRNVHSTSGTVTNYLRHIWGLDSILQELNIEKYRACGQTVKEIIGSNGSTKENERIVNWSKRDDHRHHAIDAIVIALTKQSHIQKLNNLNQEFQNYRELKQSAYNFPLPWATVHSDVLRTVSNILVSFKSGKKVATKNINRIKKNGKVVKELPTLTPRGFLHKDKFYGKIKRYETVPLTPRFKEWDRIADNNIYNQLKERLSRYKDNTKLAFSENEKDPIPKSLQSITLFQEKFVIRQELNKDFNLARTENIIDERIKRIVKGRLSQNQGNPIKAFGDLENDPIWINKEKAIDIKAVRCFTDLKDLSSLHKNDKGENIHYVSTKNNHHIAIYEDQNGNLAFNAASFWDALNRKLHDLPVIIKDPKSLWNKVLEKGIDNQDVLSNLPPENCSFRTSLQQNEMFIFGMTREEIEDDIRNENYSRISKGLYRVQNISTGKGIDVFFRHHLETKLQDSNNDKEVGKFIRCRTLNSLSLIKVLINYTGSIYLYD

SEQ ID NO: 675 - protein, 1223 aa, unidentified
  REGION 1..1223: note = Description of Unknown: uncultivated organism with predicted taxonomy: Bacteroidetes
  REGION 1..1223: note = MG7-12 effector
MEKVLGLDLGVSSIGWAMTLQDPNNEERNEIIDCGVRIVPLDTDEIKEFGKGGNVPTNVARRQARGMRRNLQRYRWRRQQLFRALKQLGMLPDERLLRQLSPLQLYALRERALSEPLSLPEMGRVLIHLNQWRGYRSNRKEQTESDGKKPSEYLEQIEKNEERLQGQTIGQYFAARLRESGGYRIRQQLFSRETYKQEFDRIWEKQAEYHPQVLTEANRSWIRDRIIYWQRPLKSAKGLVGECALEWCYALDKNQQPIRLPNGQLKIVRPKCAPKSSPLVQVCNVWESIHNLRVYDHFGEERPLSQEEKERLFRILQDRSLTARQIIKDVLLLSPKTHTVDRLIQEKGLEYNRTRARLLEVFKEQKINREDLLEFNPVIEEVEWDNPETGERLRRLQVRGDFTQQPLYQLWHLLYATEDERNLVALLQKRYGFTEAQAKALAKLDFTSAGYARKSHRALRRLLPHYQRGLDYAAAAQAAGYRHANQMTKEENQARPLLDRLEVLPKNSLRNPVVEKVLNQLVHLVNDLIATYGRPDEIRIELARELKQSAQERQQIEKLINKNKKTNEEARKKIAEILGIDPQAVSRTMIEKWKLYEETDGLSLYSGKKIDLPTLLRGNAVDIDHIIPRVSRFDDSFQNKIFCEASLNQAKSNSTAHDFMRDQPVSGLQPYDDYRKMVKDLYEGKKISKAKYDNLMMTAEDLLKDEEFLQRQLRETQYIAKKAVEMLRQVCREVRSTTGSITDFLRHQWGWDEVIKELRLPQFRQAGEDLIEYRPAANGGRDRVVIKDWDKRKDHRHHALDALVVAFTRVSHIQRVTKLNQIMSGKFGEERRKELLRTGRDLYIAGKAPFTFAQVSKAIANILISFKQGLRVATRSRNRPKGSTTVQITLTPRGALHEETVYGRIKRYKKVPLNGKFSPAMVTEIAHPHQRALVEARLAQHNGDPKKAFKDLEKHPITYGPNGSKHLTHVTVWDYVLVARKSVDASLSEKAVEKIADRGVRRAVAERLKAGGGKSKEAFKNVGTDPVQPPRHHPVKRVRVENYAEKAIRLPRGYVEPGSNHHIAIYRDADGNKHEHVVTFWDAFQRVRLGLPAIITDVPAALQYAQDQLPEGVTDLLLPEGWDWQFVVSLARNDMFVFDLDPSEIDFTDPNNRARISRHLFKLRKASKKQYWFLHHLETEVLEDLASKKAYRCKQCSMESLAGAVKVKINRLGHVVEVGQPFS

SEQ ID NO: 676 - protein, 1134 aa, unidentified
  REGION 1..1134: note = Description of Unknown: uncultivated organism with predicted taxonomy: Deltaproteobacteria bacterium
  REGION 1..1134: note = MG7-13 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQHKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQYLIKKKKVKSDTLLKRALRLDPEAGGYSIDNYEEIEGDVTRAAILSAFKKAEQRPPQWLFRFDPTREIEQQPLFQLWHMLYSIEDPAALQRKLQEKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANREKGNRTAYEYMEQKGELEKFREHVMNTNYPFPKKKRLLSPEVPEDFIQRQLKETQYITKVVREKLWEVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLQAVVPVHHKADGTSVDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 677 - protein, 1134 aa, unidentified
  REGION 1..1134: note = Description of Unknown: uncultivated organism with predicted taxonomy: Deltaproteobacteria bacterium
  REGION 1..1134: note = MG7-14 effector
MKKILGLDIGTNSIGWALITEPENGESGEPEILRCGVKVIAMDQKQINAFEGGQALSANQERRLKRQMRRNNWRYKLRREALVARLVELGWFPREWKDDLQARHEALKLHDARYIYGLRDKAARGERITLRELGLIWYHLNQKRGYKSNRKAQDEEESNDSVLLSQIAANDQLLREQGLTVGQYLYQQYKEHPRRPLKGKVFSRKAYLEEFDRIWEAQAAHYPDILTPELREEIRDRIIYYQRPLKSQKHLIAECPFEKRYYKDANGQLQVKGIKVAPRSSPVFQEYKIWQTLANIRITNLALAGQMGFDDRGERPLTEQERELAYQFLIKKKKVKSDTLLKRALRLDPEAGGYSIDNYEEIEGDVTRAAILSAFKKAEQRPPQWLFRFDPTREIEQQPLFQLWHMLYSIEDPAALQRKLREKFDFDDELAAALTRVTFKEDYGSLSTRAMQRLIPHLKNGLTYDKARVKVYEETGIDSYKTHTLSKDEQLQRALAPAIEQIKVNSLRNPVVERIVQHVINLVNAIIADKSLVSDEERQSGKFEIRMEMARELKQTAKQRQKTSKQIRAREQQREAARNRLIEEGILTRPSRADIDRYLIWLEGNQMCPYTFKPIPISDLFNGRCDVDHIIPRSRLFDDSQLNKVVCYAAANKEKGNRTAYEYMEQKGELEKFREHVMNTNYPFPKKKRLLSPEVPEDFIQRQLKETQYITKVVREKLREVSHEVRTTTGAITGFLRHEWGLSNLLHDLNFPKYEAQGLVEEWVDEETGEVIKRIEDWSKRMDHRHHALDALVVALTRPAHVHYLNNLNKQFGNLARENGWRTPLRSPVTNLYQKARAAMEPILVKHQKKSRVVTSMTHRLKVKGHFSGKTQEVLVPRGPLHKESVYGLIHDNGKEEFVIRYPLDTNFRPEYVPYIVDKKVQQIVAARLRQFGNDPKKAFADLESDPIWFDEERKIPVKRVRCRTGLHAVVPVHHKADGTPLDYVQTRNNHHLAIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 678 - protein, 1003 aa, unidentified
  REGION 1..1003: note = Description of Unknown: uncultivated organism with predicted taxonomy: Collinsella
  REGION 1..1003: note = MG14-1 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 679 - protein, 1034 aa, unidentified
  REGION 1..1034: note = Description of Unknown: uncultivated organism
  REGION 1..1034: note = MG14-3 effector
MAKLAPIADPRDFGFDPETVASALMPYEQFSSKPRRLILGIDMGVASIGLALIDVLNGEIVLMASHIFKQPIVDKTKVSLAVSRRGYRSSRRNITREKNRKKAIRKLAADTGIAPAGAAADWFARRKGEPEVLALRVDALTRKLTDRELARILYSFASHRGYIDHGKGDKGDTEDGKVKKALSANLKILDEGGYETYAQYLATQPRSRNKRDDYTFSIDIATVAHEVSRIFAHQREMGNTKATVSLEQSYLAALCWLTDTTKKDKKTYDKVGYCTYLGKPEKRAASSALSYELVRAYQTLANVKIEHRGAAPTCISPKTRNEIVADLFKVTGKPKPLKWSQLRKRLHMAETDTFAGRLKSDEAADCIKLPAWTALCAGLYDKAPKLLEDMHEEPDFADSVCSCLTFASGESSLRSALGNLSADFTPAELAALLDLPYTSKAFSGYGTSGLKALHMLRSAFESEDVVTLYDAEEATGLYEARAALAADRNASLDGLLSPYVEFDPTCTNPVVLRATARLRRMVNSVIKHYGMPDAIRVELARELKHSAHEKRLINASKNKNEKVNAKARQDLIDYYHLPSDAHIKTGDFRKVKLYNEQGGKDPYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDRGKSGRWLFDPIYYVDIPHLSKDRMRVFSKDKAIDYWETTEIDPESPQLMIKMGDVLLQDGRAMRFYNFNVATGGICSYVTGAPHKSLQKTGPLSCESFPTPMKWASDLKIMHEDSLGLCWLRFLVARTESCDGA

SEQ ID NO: 680 - protein, 1005 aa, unidentified
  REGION 1..1005: note = Description of Unknown: uncultivated organism with predicted taxonomy: Coriobacteriales
  REGION 1..1005: note = MG14-4 effector
MQSTVNREIGKLGLPRHLVMGMDPGISSCGFALIDTKNHEILEMGVRLFDSPTHPKTGQSLAVIRRGFRSTRRNIDRTQARLKHCLETLKRYGVVPQDATKDYFHTAKGDKQPLKLRVEGLDRLLTNREWALVLYSLCKRRGYIPHGEGSQDKSSEGGKVLSALAANKEAFDQGSFRTVGEWLASQPQSRNRGGSYDKCVTHAQLVNEAHTLFEKQRAFESKVASTELEAAYIEVCDWERSRKDFDCRTYELVGYCSYFPQEKRAARCTLTSELVSAYGALGNVTIIHEDGSSRSLTAAERDECIAILFSCEPIRGNKDCTVKFGALRKVLDLSSGDYFKGVPTSEEKTREVYKPKAWRVLRNTLNPINPILLHRLRDDRDLADSVMEAVAYSSALPVLEEKLQELPLSEAEVTALCKLPYSSKVLNGYGNRSKKALDILLGCFEEPEVLTLTDAEDASGLLAMRIEGAGLERSDRLMPYEGWIEKTGRTNNNPVVIRAMSQMRKVVNAICRKWGVPNEIHVELDRELRLPQCAKDDIAKANKKNEKNRERIAGQIAELRGCSVEEVTGKQIEKYRLWEEQECFDLYTGDSIDVMRLIQDDSYTQIDHILPFSRTGENSKNNKVLVLAKSNQDKREQTPYEWMHSGKPSAPSWSDFERRVQENQKLSRRKKNFLLEKDLDSKEGEFLARSFTDTAYMSREVCSYLSDCLLFPEDGSKVHVVPTTGRATAWLRRRWGLNFGSTGEKDRTDDRHHATDACVIAACSRSLVIKTAKISQETHWSVTPGLTESQRKDARMKALESVMPWETFANEVRSRHDFVVPTRFVPRKGKGELFEQTTYQYAGVNDKGKDLARRVGSDKDIVMGNAVVSEDGKSVVKVSEMLCLRLWHDPDAKKGKGCWYADPVYKADIPALKDGSYVPRIAKAHSGRKAWKPVPESALKGGTIEIYLGDIVRIGDFIGRFSGYDINSANWSFVDRLTRNPIKCPTVGKLNNLIIPIVTRENIVE

SEQ ID NO: 681 - protein, 1005 aa, unidentified; identical to SEQ ID NO: 680
  REGION 1..1005: note = Description of Unknown: uncultivated organism with predicted taxonomy: Actinobacteria
  REGION 1..1005: note = MG14-5 effector

SEQ ID NO: 682 - protein, 1037 aa, unidentified
  REGION 1..1037: note = Description of Unknown: uncultivated organism with predicted taxonomy: Collinsella
  REGION 1..1037: note = MG14-6 effector
MAKLAPIADPRDFGFDPETVASALMPYEQFSSKPRRLILGIDMGVASIGLALIDVENGEIVLMASHIFKQPIVDKTKVSLAVSRRGYRSSRRNITREKNRKKAIRKLAVKSGIAPAGASADWFARRKGEPEVLALRVDALTRKLTDRELARILYSFASHRGYIDHGKGDKDDIEGGKVKKALSANRKILDEGGYETYAQYLATQPRSRNKKDDYTFSIDIATVAHEVSRIFAHQREMGNTKVTVSLEQSYLAALCWLTDTTKKDKKTYDKVGYCTYLGKPEKRGASSALSYELVRAYQTLANVKIEHRGADATHISPKTRNEIVADLFKVTGKPKPLKWSQLRKRLHMAETDTFAGRLKSDEATDCITLPAWTALCVGLYDKAPKLLEDMHEEPDFADKVCSCLTFASSESSLRGALSQISADFSPVELAALLDLPYTSKVFSGYGTSSLKALHMLRGAFESEDVATLYKAEKATGLYEARAALAANRNASADGLLSPYVEFDPTCTNPVVLRATARLRRMVNSIIKHYGMPDAIRVELARELKHSAHEKRLINASKNKNEKINAKARQDLIDYYHLPSDAHIKTGDFRKVKLYNEQGGKDAYTGEGIDFARMLAQSDYTEIDHILPISRSCDDSQSNKVLVLTKSNRDKSNRTPYEWMTSGESTAPDFAEFSARMQLWAENCELKRLASSKLKKLLNKDFTDKTQDFIARQLNDTRYMSRAVAKWLDGCLPFPDDGHRHVFAVSGGATAMLRRAWDIAILDEEGKKDRDDDRHHAIDAALIAACTPSIVMKVAKANEMWQSDAERESLFLGSMPFPDFKQKVEAWIPCIVPTLYLPRNATGSLFNDSFYSYRGTDARGKDLLKQNGTVKPKTTVWKDGNGTAKTYDGVYGLHAVFDKDSGKSGRWLFDPIYYVDIPHLSKDRMRVFSKDKAIDYWETTEIDSESPQLIIKMGDVLLQDGRAMRFYNFNVATGGICSYVTGAPHKSLQKTGPLSCESFPTPMKWARDLKIMHEDSLGLCWLKFLTDRTDRCALESIQ

SEQ ID NO: 683 - protein, 1003 aa, unidentified
  REGION 1..1003: note = Description of Unknown: uncultivated organism with predicted taxonomy: Collinsella
  REGION 1..1003: note = MG14-7 effector
MEITINREIGKLGIPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKVLSALTANQEALAETPCRTVGEWLAQQPQSRNRGGNYDKCVTHAQLIDETHILFEAQRSFGSAYASPEFEAAYIEVCDWERSRKDFDRRTYDLVGHCPYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEVVAYSSALPVLQERLQGLPLSEAEIEALCRLPYSSKALNGYGNRSKKALDMLLDCLEEPEVLNLTQAENDCGLLGLRIAGTQLERSDRLMPYETWIERTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDGTYTQIDHILPFSRTGENSRNNKVLVLAKSNQDKREQTPYEWMSHDGAPSWDAFERRVQENQKLSRRKKNFLLEKDLGTKEGEFLARSFTDTAYMSREVCAYLADCLLFPDDGAKAHVVPTTGRTTAWLRRRWGLNFGLTGKKDRSDDRHHATDACVIAACSPSLVIKSAQINQKMHWSMTKGMSKAQRQDAIMKALENVMPWETFANEVRTVHKLIIPTRFVPRKGKGELFEQTVYRYAGVDAKGKTLARRANSTEDIVMGNAVVSDDEKSVIKVSEMLCLRLWHDPKAKKGQGAWYADPVYKADIPALKDGTYVPRIAKAHTGRKAWKPVPESAMKKPPLEIYLGDLVQIGDFVGRFNGYNIDNANWSFVDRLTRIKTSCPTVGKLSNDMSPFVVRESPIK

SEQ ID NO: 684 - protein, 1000 aa, unidentified
  REGION 1..1000: note = Description of Unknown: uncultivated organism with predicted taxonomy: Olsenella
  REGION 1..1000: note = MG14-8 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMSSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITEDKGKYPLVRAGENTVKKGNVRINPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 685 - protein, 1002 aa, unidentified
  REGION 1..1002: note = Description of Unknown: uncultivated organism with predicted taxonomy: Olsenella sp. KH3B4
  REGION 1..1002: note = MG14-9 effector
MDVTRPYLVLGLDPGIASCGFCLLDMTNHKILEMGSHLFKAPQEDKTKTSLAVTRRNARSIRRNTARTAARLKHCMELLVAAGLVPEDADKTWFQTRKGDKPVLKLRAGGLDRLLTDREFAQVLYSLCGRRGYIPHGEGRLGETDDTEGRKVLDAIKKNQAAMAAGSYRTVGEMLNAQGRSRNRGGDYALCVYNSQIQDEVKALFAAQRAHGNAAATEALEDDYLACLTWEKKSLEHDARVYELVGECPYFPGEKRAASADISSELCRAYERLGHIVIVHEDGSEQTLTANQIDGYLKILFSTASIKGNKDCKVTYGAIRKNLDISGKSVFKGIAQDKEKEEVFAPKAWRCLRHALPEELLARMVEDRQLGDAICEALTFASSEASLIERLSDLDLTDDEREAVLGVPFTGKLFKGYGSRSLKALGLLLGAFEEPEVRTLTDAERATGLLDLRQSDRGVRGQYLPPYNSYDETCRNPVVLRAMGRMRHIVNAIIRIHGVPDEIHIELGRELKMSNKEKSLVDKRNRENAAANKKWAEKAAGILGCTPEEVSGRVIRKLILREEQGEKDLYTGQPIDLERLVRDDRYCEIDHILPYSRTCDDSRTNKVLVLSKSNQDKRERTPYEWMTSGETGAPSWDEYHARIMATVKNPRKRANYLNTDLGPETQAKFLARNLNDDRYMSVAVKNYLEDCLLFPEDGRKRHVIAVAGGATGNLRWVWGLNFGDGNVKDRTDDRHHAVDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 686 - protein, 880 aa, unidentified
  REGION 1..880: note = Description of Unknown: uncultivated organism with predicted taxonomy: Collinsella
  REGION 1..880: note = MG14-10 effector
MLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 687 - protein, 813 aa, unidentified
  REGION 1..813: note = Description of Unknown: uncultivated organism with predicted taxonomy: Collinsella sp. AF20-14LB
  REGION 1..813: note = MG14-11 effector
MAAFENPRESGFDPELVKTALMSREQFCSKPRKLILGIDMGIADIGICLMDELNYEIVLMATHLFDCPRNPKDQTSLASTRRQARSQRRNIARRAARKKHIRTILMAHGVIPEGTTADWFSVRRGEQDNIQLRVKGLSEVLTDRELARVLYAFASRRGYIDHGKADNDKDAGKVKKALKANAEIMEANGYETFAQYLVTQPRIRNRQNDYTHCIDIDMVVDEVHAIFRHQRELGNELATESLEGEYLATLRWLTDTTRRDRIIYSKVGYCTYLGEPVKRAPKSSISSEMVRAYQTLANVKIEHIGGPATQIAPAVRNQIVHELFKVSKNPKPLKWSQLRKKLDLADTATFAGIRQSDEKNDACVTAPAWNALCSTLHDLNPTLLNRLHDDIDLADAVCAAATFASSSEAFATRIAELTDGLSKEDVEALLELQYGSKLFTGYGSTSLKALQMLRDAFEDAKIERLYDAEVATGLYDAREALAARHNAPDNGFLKPYSSYSPICTNPVVLRSCAQLRRIINSIIRHYGLPDTIRVEVANDLKHTKREKKLITSGNIYNRKVNEKAKDDIVEFLGLANADRVRGRDLEKVRLYNEQGGKDPYTGQGIDFGRMLTEKSYVEVDHVLPFSRSCDNSKTNKVLVLTKSNRDKANRTPYEWMTSGEPTAPNWDEFCIRMDVWASGKEPKHYYSSKLAKLKEDNFTNNIDSFISRNLNDTRYMSKDVAKWLADCLPFPKDGRRHVFCVSGAATGLMRRVWRIGILDENGKKDREDDRHHAVDAAVIAACTPSVVKSIALISEEHATHRDADRLLNRSLPY

SEQ ID NO: 688 - protein, 1005 aa, unidentified
  REGION 1..1005: note = Description of Unknown: uncultivated organism with predicted taxonomy: Collinsella
  REGION 1..1005: note = MG14-12 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 689 - protein, 1005 aa, unidentified
  REGION 1..1005: note = Description of Unknown: uncultivated organism with predicted taxonomy: Collinsella
  REGION 1..1005: note = MG14-13 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKAIDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 690 - protein, 1000 aa, unidentified
  REGION 1..1000: note = Description of Unknown: uncultivated organism with predicted taxonomy: Olsenella
  REGION 1..1000: note = MG14-14 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 691 - protein, 1005 aa, unidentified
  REGION 1..1005: note = Description of Unknown: uncultivated organism with predicted taxonomy: Coriobacteriales
  REGION 1..1005: note = MG14-15 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEDNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 692 - protein, 1046 aa, unidentified
  REGION 1..1046: note = Description of Unknown: uncultivated organism with predicted taxonomy: Eggerthellales
  REGION 1..1046: note = MG14-16 effector
MDKALGTDIGELGFDPGTFATALMTLEEFRSKDRVIWAGLDIGVASTGLCLVDVLNHEIVLMASHLFKSPVVDKKKATAAPESLASVRRGARSVRRNIMREGRRKKAIRAALSDFGLIPADAGGEWFAARRDERTVVRLRPKALEYLLNSREFARVLYSFASHRGYIDHGKSDKDDDAGKVKKALAANHAALADGGCKTFGQYLAGQPRSRNRPGNYSYTADIDMTVDEVRTIFARQRELGSEIASEALEERYIAELTWLTDTSKRDMSTYLKVSLCTYLGAPYRRGATSTISFEMVRAHQTLCNTVILHADGTSSTIPGNIRIEIVRELFAVKKSVKPLKWSGLRRRLGLAECDSFKGSPAEEEKRDCIALPAWAVLCSGLYEGHRDLLERLHDHIDDADAVCSALTYATSAASLAGRLAPLALTDDEVEAIIDLPYSARLFSGYASASLEALQMLRGTLEDPCVTSLRQAEEDSGLAQARAMLAEERGGAADGLLCAFSDYDPTCKNPVVLRATAQVRRMVNSAIRHYGLPDVIRVEVARELKRSKHEREVVAESNRARRELNEQAKRDIVEFLGLPDDHHVRGRDLDMVKLYREQGGKDPYTGAGIDFRRMLEEHGYAEIDHILPISRTCDDSQANKVLCLTKSNRDKSNRSPYEWMTSGEAAAPDWDEFCGRMDRWAKMCEPRRYVRKKLANLTCENLAEHAEDFIKRNLNDTRYMSAALAKWLRECLPFARDGHEHVFCVAGGATALMRSVWDIGITGPDGKKNRDDDRHHAVDAAVIACCTPGIVKNVALVNEGHARADVRQRLFSDSLPYPEFKEQVNAWIPCIVPTLTLPNTVTGSVLKDTVYPYLGRDEAGKDLYLTVKRDKDGRIVERKVNKATTMWKDGQGGCRAYGSMRALDAVFDASAGKRGRWSFDPVYCIDIPHRDAERRTIRAFSKEKAIDLWDTVEVPEAAPRMTIRRGDVLVCDGKAARFHCFDISVNAIRLFSQRGGKQLQATGPLSAEAFPPPSKWGEGVRVMQEDCLGLCWLSFLAQRAADMQSE

SEQ ID NO: 693 - protein, 1005 aa, unidentified
  REGION 1..1005: note = Description of Unknown: uncultivated organism with predicted taxonomy: Collinsella
  REGION 1..1005: note = MG14-17 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREAYKPKGWRVLRNTLNAANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 694 - protein, 1000 aa, unidentified
  REGION 1..1000: note = Description of Unknown: uncultivated organism with predicted taxonomy: Olsenella
  REGION 1..1000: note = MG14-18 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMLEDRKLGDAVCEALTFASSEASLIERLSDLGLSDDERDAILAVPFTGKLFKGYGSRSLKALDLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRACAIHIARVNWEPVPEAAMGANPVIVFFGDVLSVDDHVGRFGGFDIFGGRLALLNLLTKQKVSDWPSLGSWGKDTQVRVLQEDCLGHCYDSIAINPEGSTFQQR

SEQ ID NO: 695 - protein, 1005 aa, unidentified
  REGION 1..1005: note = Description of Unknown: uncultivated organism with predicted taxonomy: Coriobacteriales
  REGION 1..1005: note = MG14-19 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAAHCTLTSELVAAYGALGNITIVHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKNLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIAHKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 696 - protein, 1005 aa, unidentified; identical to SEQ ID NO: 688
  REGION 1..1005: note = Description of Unknown: uncultivated organism with predicted taxonomy: Coriobacteriales
  REGION 1..1005: note = MG14-20 effector

SEQ ID NO: 697 - protein, 1000 aa, unidentified
  REGION 1..1000: note = Description of Unknown: uncultivated organism with predicted taxonomy: Olsenella sp. KH3B4
  REGION 1..1000: note = MG14-21 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 698 - protein, 1005 aa, unidentified; identical to SEQ ID NO: 693
  REGION 1..1005: note = Description of Unknown: uncultivated organism with predicted taxonomy: Collinsella
  REGION 1..1005: note = MG14-22 effector

SEQ ID NO: 699 - protein, 1005 aa, unidentified; identical to SEQ ID NO: 688
  REGION 1..1005: note = Description of Unknown: uncultivated organism with predicted taxonomy: Collinsella
  REGION 1..1005: note = MG14-23 effector

SEQ ID NO: 700 - protein, 1003 aa, unidentified
  REGION 1..1003: note = Description of Unknown: uncultivated organism with predicted taxonomy: Collinsella
  REGION 1..1003: note = MG14-24 effector
MTSTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRNFGSQYASAELEEAYVQVCDWERSRKDFDRRSYDLVGYCTYFPTEKRAARCTLTSELVAAYGALGNITIVHEDGTTRTLTAAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKKNEKNRERIAGQIAELRGCNPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAKISEQTHWTVTKNLDKDERDHLRMKALENVMPWETFANEVRASHDFVIPTRFVPRKGKGELFEQTTYRYAGVNDKGKDLARKANSDQDIVMGNAVVSDDGKSVIKVSEMLCLRLWHDPEAKKGQGCWYADPVYKADIPALKAGTYVPKIAKAHTGRKAWKPVPESAMKHAPLEIYLGDLVKIGDFIGRFSGYNIDNANWSFTDRLTRQKLSCPTVGKLNNALIPVIIRESSIR

SEQ ID NO: 701 - protein, 1002 aa, unidentified
  REGION 1..1002: note = Description of Unknown: uncultivated organism with predicted taxonomy: Olsenella
  REGION 1..1002: note = MG14-25 effector
MDVTRPYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKIAEASSKGREAFKKQRESRLADTQPWPTFADEVKARRAFVVPTRMADHGVTGRVFEDTLYHLEGITADKGKYPLVRAGEKTVKKGNVRINSDGSVKLIDGMAFLRLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 702 - protein, 1005 aa, unidentified
  REGION 1..1005: note = Description of Unknown: uncultivated organism with predicted taxonomy: Coriobacteriia
  REGION 1..1005: note = MG14-26 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRGGNYDKCVTHAQLIEETHILFTAQRSFGSKYASPEFEAAYIEVCDWERSRKDFDRRTYDLVGHCSYFPTEKRAARCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKLSEMLCLRLWHDPEAKKGQGAWYADPVYKADIPALKDGTYVPRIARAAIGRKAWKLVPKSAMTKPPLEIYLGDLVQIGNLFGRFSGYNIANGSWSFIDRLTKEALSCPSVAKLNNNLFPTIIRESIIMRK

SEQ ID NO: 703 - protein, 1005 aa, unidentified; identical to SEQ ID NO: 693
  REGION 1..1005: note = Description of Unknown: uncultivated organism with predicted taxonomy: Collinsella
  REGION 1..1005: note = MG14-27 effector

SEQ ID NO: 704 - protein, 1009 aa, unidentified
  REGION 1..1009: note = Description of Unknown: uncultivated organism with predicted taxonomy: Collinsella
  REGION 1..1009: note = MG14-28 effector
MAAFEDPRGHGFDPDLVRTALMSREQFSSKHRKLILGIDMGIADVGVCLMDELNHEIILMAAHLFDCPWNPKTKTSLASARRQARSQRRNIARRAARKKHIREILMAHDVIPEGATAEWFSVRKGDQDNIQLRVKGLSEVLDSRELARVLYGFAGRRGYIDHGKADNDKDAGKVKKALKTNAEIMEANGYETFAQYLITQPKIRNRQDDYTHCVDLDMVVDEVHAIFRHQRELGSNLATESLEGEYLAALRWLTDTTKRDRIIYSKVGYCTYLGEPIKRAPKSSISSEMVRAYQTLANVKIEHIGGPATQIAPAVRNQIVHELFKVSKKPKPLKWSQLRKKLDLDDTATFAGIRQSDEKKDICVKAPGWNTLCSTLHDLNPTLLNRLHDDIDLADAACAAATFASSSESFATRISELTDELSKEDVEALLELPYGSKLFTGYGSTSLKALQMLRDAFEDTSINRLHDAEVATGLYDARKALAAKHNVPDDGLLKPYSSYSPICTNPVVLRSCAQLRRIINSIIRHYGLPDTIRVEVAKELKHTKHEKKLVDDGNKYNKREKEKAADDIVEYLGLSSADQVRGRDIDKVRLYNEQGGKDLYTGQGIDFGRMLTEKGYVEIDHILPYSRSCDNSRTNKVLVLTKSNRDKANRTPYEWMTSGEPTAPNWDEFCIRMDVWASGKEPKHYYSSKLAKLKEDNFTNNIDSFISRNLNDTRYMSKDVAKWLTDCLPFPEDGRKHVFCVSGVATALMRGIWRIGILDDDGKKNREDDRHHAVDAAVIAACTPSIVRGIALISEEHATHRDADRLLNRSLPYPEYRDQVKAWIPCIVPTYSPNRTATGALFEENTYSYRGVNEKGKDLIKKKKGKLGPCTTAWKDGKGSAKAYDKQYSLLAVYDESTLRWLIDPLYYIDVQKRKHEEPFMRKFSKNLSIDYWEKIPLTGTERALFLKPGVVLTQDGLVGRLHSYDISDNKVRMYYARGETSFQKTGPLAGEKFPTFSKWTDNLKVMQE

SEQ ID NO: 705 - protein, 1005 aa, unidentified
  REGION 1..1005: note = Description of Unknown: uncultivated organism with predicted taxonomy: Coriobacteriales
  REGION 1..1005: note = MG14-29 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLERLLNDREWALVLYSLCKRRGYIPHGEGNQDKSSEGGKVLSALAANKEAIAGTSCRTVGEWLAQQPQSRNRDGNYDKCVTHAQLIEETHILFTAQRSFGSKYASPEFEAAYIEVCDWERSRKDFDRRTYDLVGHCSYFPTEKRAAHCTLTSELVAAYGALGNITIIHEDGTSRALSATERDECIAILFSCEPIRGNKDCAVKFGALRKALDLSSGDYFKGVPAADEKTREVYKPKGWRTLRNTLDTANPILLQRLRDDRDLADAVMEAVAYSSALPVLQERLQELPLSEAEIEALCKLPYSSKALNGYGNRSKKALDMLLDCLEEPEVLNLTQAENDCGLLGLRIAGAQLERSNRLMPYELWVERTGRTNNNPVVIRSMSQMRKVVNAICRKWGVPNEIHVELDRELRLPQRAKDEIAKANKKNEKNRERIAGQIAELRGCTTEEVTGKQIEKYRLWEEQECFDLYTGAKIEVDRLISDDTYTQIDHILPFSRTGENSRNNKVLVLAKSNQDKRGQTPYEWMSHDGAPSWDAFERRVQENQKLSRRKKNFLLEKDLDAKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDIARKASSDKDIVMGNAVVSDDEKSIIKVSEMLCLRLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 706 - protein, 1005 aa, unidentified; identical to SEQ ID NO: 695
  REGION 1..1005: note = Description of Unknown: uncultivated organism with predicted taxonomy: Collinsella
  REGION 1..1005: note = MG14-30 effector

SEQ ID NO: 707 - protein, 1001 aa, unidentified
  REGION 1..1001: note = Description of Unknown: uncultivated organism with predicted taxonomy: Coriobacteriia bacterium
  REGION 1..1001: note = MG14-31 effector
MVSPKTTFSERESNYLVLGLDIGIGSCGWCILDKAHNIIVDMGVRLWSPPQENKTKASLASTRRAARSSRRNCKRTKDRKKHCFKLFKAEGIAPSDAEANWVQTKAGEKPTIKLRAAGLNRKLSSREWAQVLYSLCSRRGYIPHGESDDDSEGKAVLAAIKTQQEKLDNNEFRTVGELLANGTHCRNHSGDYSLCVSNNQIRNEVAALFEAQRKLGNKHASETFEQQYLECLTWQKSVTDHDEIIYSKVGPCTYFKQEKRAADSCLSSEMCKAFESICHVTYVDSDGVEGKLPPDIKQRAIDVWFSPTSLPKNKDCKVEYSDLRSWLKAELCIGDDFFFKGVERDDENSKEPFKPSRWRNQRKQLSPSLMLSMRNNRRLADGIDSALAYASSKESLQHQLDELPLSEVDIEELCSLSYSSRLYSGYGTRSLKALDLLIESFESDEVSTLAEAEKASGLLSLRQSSSTEKGFTLPPYIAFDPTCTNPVVLRVMGQVRKVINACIAEYGPFDEVHIELARELKQSAKEKDAILKSNNKTNKSREVLRKKLAEELSCDEDAIPFKLLEKIELWNQQDGRDLYVDEPIQYERLISDDSYCEIDHILPYSRTCDDSRMNKILVLQKSNQNKRESTPFEWMSATGDWDNFKLRILRLAHYPQKKKQRLLNTDLAEKQPEFIARNLNDTRYASLAAKRYIEEYLTFKDNGKSRHVIAVAGGATAALRNAWGIRKDRSEDNLHHAVDASIIAACDESTVIAIAKASERKALTPKDKRKELFSRTEPWQDFANEVLSRKEHIIPSFMTDHKVSGRIFEDTVYRFDGYNEAGTKGILTATKEGMPKSKPSGNYIVRDDGSAVIPDGLAFLRLWWDPTFKVRKGKEPGCYIPEPVFLSDLPKAFDCDYIPLIAPPQKDKKPREKWDSLSEELRNQKPVVLFRNDAIVIGSTVRRFAGFDIDGCSWTLLDPLGKMSQKEATKGLRISSIGPKTRFSVIHEDPLGKCFAPFLED

SEQ ID NO: 708 - protein, 839 aa, unidentified
  REGION 1..839: note = Description of Unknown: uncultivated organism with predicted taxonomy: Olsenella sp. KH3B4
  REGION 1..839: note = MG14-32 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPPCRNPVVLRAMGRMRHIVNAIIRIHGVPDEIHIELGRDLKMSNKEKKQVEKRNRENAANNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASTKGREAFKQLRKSRLADTQPWPTFATEVAARREFVVPTRMADHGVTGRVFEDTLYHLEGITEDKGKYPLVRAGENTVKKGN

SEQ ID NO: 709 - protein, 1005 aa, unidentified; identical to SEQ ID NO: 693
  REGION 1..1005: note = Description of Unknown: uncultivated organism with predicted taxonomy: Collinsella
  REGION 1..1005: note = MG14-33 effector

SEQ ID NO: 710 - protein, 1000 aa, unidentified
  REGION 1..1000: note = Description of Unknown: uncultivated organism with predicted taxonomy: Olsenella
  REGION 1..1000: note = MG14-34 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLNLRLSDRGVRGQLLPPYDSYDPTCRNPVVLRAMGRMRHIVNAIIRIHGVPDEIHIELGRDLKMSNKEKKQVEKRNRENAASNKKWATTAAGILGCTPEEVPGRIIRKLILREEQGEKDLYTGDSIDLEHLVRDDRYCEIGHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 711 - protein, 1002 aa, unidentified
  REGION 1..1002: note = Description of Unknown: uncultivated organism with predicted taxonomy: Olsenella sp. KH3B4
  REGION 1..1002: note = MG14-35 effector
MERNRPYLVLGLDPGIGSCGFCLLDMTNHRILEMGSHLFDVPQEPKTKTSLAVTRRNARSIRRNTLRTRMRLKHCLGLLKDAGLVPQDADKNWLQSTKGDKPILKLRSCGLDRLLTDRELAQVLYSLCTRRGYIPHGEGRFGETDDVEGRKVLAAIKTNNKAMESGNYRTVGEMLHARGKSRNRGGNYDFCVLNSQIQDEVRTIFSAQRTLGNDRASTEFEEKYLDCLTWEKKTLDHDKRTYDLVGKCSYFPEERRAALACLSSELCRAYERLGHLVIVHEDNSEQVLTAQQIDVYLKVLFSPAPLKGNKDCKVTYSAIRRDLDLSGKSVFKGVSQEKEKDEVFAPKSWRRLRKTLPEDLMVRMRNNRELADDICEALTYASSEDSLLTQLEPLDLSENETEAVLGVPFSGKFFKGYGSRSRKALGILLGAFEEPEVRTLTDAEKATGLLDHRLANDTVRSVLLPPYVTYDETCRNPVVLRAMGRMRHVVNAIIRIHGVPDEIHIELGRDLKMSKREKDAVSKRQRQNEATNKKWAKTAAGILGCEPEEVPGKVIRKLAMREEQGEKDAYTNAPIDLERLVREDHYCEIDHILPYSRTSEDSRANKVLVLSKSNQDKRERTPYEWMTQDVGKPGVPNWDEYHARVVATVKHPRKRANLLNTDLGPETEAKFLARNLNDDRYMSVAVKNYLEDCLLFPDSDRKRHVTAIAGGATGNLRWVWGLNSGSNNTKDRSDDRHHAVDAAVIAACSEATVQKVARARSLGRETFKHMRKSRLADTQPWPTFADEVIARKEFVIPTRMADHGVTGRVFEDTLYHLEGFTDDKGKYPLVRAGQKTVKKGNVCISPDGSAKLIDGIAFVRLWLDPTARPNGKVKGKWYVEPVYYADIPAIRRGAYVPKACTIHVARTSWEPVPETALASRPITLYSGDVLRVDDHIGRYSSTDINGCRLVMLNLDSGNRVNDWPSIGSWGTTTQVQVLQEDCLGRCYGNVILHSDGSTFETR

SEQ ID NO: 712 - protein, 1003 aa, unidentified
  REGION 1..1003: note = Description of Unknown: uncultivated organism with predicted taxonomy: Coriobacteriales
  REGION 1..1003: note = MG14-36 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 713 - protein, 1038 aa, unidentified
  REGION 1..1038: note = Description of Unknown: uncultivated organism with predicted taxonomy: Coprococcus comes
  REGION 1..1038: note = MG14-37 effector
MVEYSDPRDFGFRPETVMTALMPYEQYSSKTRRLILGIDMGIASVGVCLIDIRNHEIILMASHIFKAPVEGKQKDISARQSGASIRRDYRSVRRTTKRRKNRKKAVREIEKKYILIPDDADGQWFAIRKGEPDVLHLRGKALLYKLNGRELARILYAFAGRRGYIDHGKGATDNDSGKVKKALSENRKILDENGYETIAQYLLKQPTSRNREGDYRYMVDIEMVTDEVHTIFRHQRDLGSDIATEGLEGEYLSALRWLTDTSARDEKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKSDCIKIPAWNALCTGLFTSNRALLDRLHDDTDIADAVCSALTYASSGESLRNALENLSLDLSEQDIDSLLDLPYASKLFSGYCSTGVRALQMLRDAFKDPQIEKLYDAEMATGLYEARQALAAERNESKDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNERDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDRRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGVDDRGKDLYRRNGKIEPASTLWKDGEGGCKLYDGVYGLAGVFDRTLKKSGSWRFDPIYYIDVPNVRQDFIRDFSKALSIDYWPKVQLKGNEPRIFLKQGDVLLQDGCAMRYYMYDVSYGGVKSYSRIGKESISLQKTGPLAEEPFPKQMKWDSSLTVMQEDCLGLCWLRFLSDRADQFENSPV

SEQ ID NO: 714 - protein, 1003 aa, unidentified
  REGION 1..1003: note = Description of Unknown: uncultivated organism with predicted taxonomy: Coriobacteriia bacterium
  REGION 1..1003: note = MG14-38 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 715 - protein, 1002 aa, unidentified
  REGION 1..1002: note = Description of Unknown: uncultivated organism with predicted taxonomy: Collinsella
  REGION 1..1002: note = MG14-39 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDALSKLPVKMPTIGRLNNETIPTVIRELLI

SEQ ID NO: 716 - protein, 1038 aa, unidentified
  REGION 1..1038: note = Description of Unknown: uncultivated organism
  REGION 1..1038: note = MG14-40 effector
MVEYSDPRDFGFRPETVMTALMPYEQYSSKTRRLILGIDMGIASVGVCLIDIRNHEIILMASHIFKAPVEGKQKDISARQSGASIRRGYRSVRRTTKRRKNRKKAVRDIEKKYVLIPDDADGQWFAIRKGEPDVLHLRGKALLYKLNGRELARILYAFAGRRGYIDHGKGTTDDDSGKVKKALSENRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVESLFAVSKNPKPLKWSQLREKLGMQSSDSFDSRLPTDEKGDCIKIPAWNALCRGLFTSNRALLDWLHDDTDIADAVCSALTYASSGESLRNALENLSLDLSEQDIDSLLDLPYASKLFSGYCNTGVRALQMLRDAFKDPQIEKLYDAEMATGLYEARQALAAERNESKDGLLCPYLEFDPTCTNPVVLRATAQVRRMINSIIRHYGMPDIIRVEVAKDLKRSKHEKAIIAATNKANKDSNEQVKKDLVAFYGLPNDAHVSSTDFEKMWLYREQFGQDPYTGKGINLERMLNDRDYVEIDHILPFSRSCDDSKSNKVLCLTKSNRDKANRTPYEWMTSGEPSAPDFGDFCGRMDAWAGKGKSAHYTKSKLSKLKNSTFGKEEQKFIDRNLNDTRYMSRQLAMWVRECLPFPDDKRQHVFCVAGAATSLMRRIWGIGVVDEKGKTDRSDDRHHAVDGAVIACCSPEIVKGIARVNSGRSNIKERERLRYESMPYPEFKDQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 717 - protein, 1003 aa, unidentified
  REGION 1..1003: note = Description of Unknown: uncultivated organism with predicted taxonomy: Collinsella
  REGION 1..1003: note = MG14-41 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 718 - protein, 1003 aa, unidentified
  REGION 1..1003: note = Description of Unknown: uncultivated organism with predicted taxonomy: Collinsella
  REGION 1..1003: note = MG14-42 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGTKIEVDRLISDDTYTQIDHILPFSRTGENSRNNKVLVLAKSNQDKREQTPYEWMSHDGAPSWNAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPKSAMKKPPLEIYLGDLVQIGDFVGRFSGYNIDNANWSFVDRLTRIKISCPTVGKLSNDMSPFVVRESPIK

SEQ ID NO: 719 - protein, 1003 aa, unidentified
  REGION 1..1003: note = Description of Unknown: uncultivated organism with predicted taxonomy: Collinsella
  REGION 1..1003: note = MG14-43 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMRYETWIERTGRTNNNPVVIRAMSQMRKVVNAICRKWGVPNEIHVELDRELRLPQRAKDEIAKANKKNEKNSERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 720 - protein, 761 aa, unidentified
  REGION 1..761: note = Description of Unknown: uncultivated organism with predicted taxonomy: Olsenella mediterranea
  REGION 1..761: note = MG14-44 effector
DFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 721 - protein, 833 aa, unidentified
  REGION 1..833: note = Description of Unknown: uncultivated organism with predicted taxonomy: Collinsella
  REGION 1..833: note = MG14-45 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFE

SEQ ID NO: 722 - protein, 1003 aa, unidentified; identical to SEQ ID NO: 712
  REGION 1..1003: note = Description of Unknown: uncultivated organism with predicted taxonomy: Collinsella
  REGION 1..1003: note = MG14-46 effector

SEQ ID NO: 723 - protein, 767 aa, unidentified
  REGION 1..767: note = Description of Unknown: uncultivated organism with predicted taxonomy: Collinsella sp. AM13-34
  REGION 1..767: note = MG14-47 effector
YRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLSPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFRVAGGATALMRSVWDIGITGPDGKKNRDDDRHHAVDAAVISCCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGWRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 724 - protein, 1003 aa, unidentified
  REGION 1..1003: note = Description of Unknown: uncultivated organism with predicted taxonomy: Collinsella
  REGION 1..1003: note = MG14-48 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSGMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 725 - protein, 755 aa, unidentified
  REGION 1..755: note = Description of Unknown: uncultivated organism with predicted taxonomy: Collinsella sp. AF20-14LB
  REGION 1..755: note = MG14-49 effector
RAASSLISFEMVRAYEKLSNIKIEHQGREATYISPEKRNEIVESLFAVSKNPKPLKWSQLREKLGMQSSDSFDSRLPADEKSDCIKIPAWNTLCTGLFTSNRALLDRFHDDTDVADAVCSALTYASSGESLRNALENLSLDLSEQDIDSLLDLPYASKLFSGYCSTGVRALQMLRDAFKDPQIEKLYDAEKATGLYEARQALAAERNESRDGLLCPYLEFDPTCTNPVVLRATAQVRRMINSIIRHYGLPDVIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGKEEQKFIDRNLNDTRYMSRQLAMWVRECLPFPDDKRQHVFCVAGAATSLMRRIWGIGIVDEKGKKDRSDDRHHAVDAAVIACCSPEIVKGIARVNSGRSNIKERERLRYESMPYPEFKAQVEAWIPCIVPTRTVSRTATGSLLKDTVYPYVGADDRGKDLYRRNGKNEPASTLWKDGSGGCKLYDGVYGLMAVFDEGMKKFGSWRFDPIYYIDVPNVRQDFIREFTKDLSIDYWTKVQLKGDEPRIFLKQGDVLVQDGCAMRYYKYNVSNGAISSYSKIGEKSVPLQKTGPLSEEKFPKQAKWDSSLTVMQEDCLGLCWLRFLSDRVGKFENFPV

SEQ ID NO: 726 - protein, 1024 aa, unidentified
  REGION 1..1024: note = Description of Unknown: uncultivated organism with predicted taxonomy: Libanicoccus massiliensis
  REGION 1..1024: note = MG14-50 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTILDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 727 - protein, 1005 aa, unidentified
  REGION 1..1005: note = Description of Unknown: uncultivated organism with predicted taxonomy: Collinsella
  REGION 1..1005: note = MG14-51 effector
MEITINREIGKLGLPRHLALGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQKCFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 728 - protein, 1003 aa, unidentified
  REGION 1..1003: note = Description of Unknown: uncultivated organism with predicted taxonomy: Collinsella
  REGION 1..1003: note = MG14-52 effector
MEITINREIGKLGLPRHLVLGMDPGIASCGFALIDTANHEILDLGVRLFDSPTHPKTGQSLAVIRRSFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHIELDRELRLPRRAKDEIAKANKKNEKNRERIARQIAELRGCTADEVTGKQIEKYRLWEEQECFDLYTGAKIEIGRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRLVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKLRSPTVNKLSNDLPPLVIREPPIR

SEQ ID NO: 729 - protein, 1004 aa, unidentified
  REGION 1..1004: note = Description of Unknown: uncultivated organism with predicted taxonomy: Olsenella sp. KH3B4
  REGION 1..1004: note = MG14-53 effector
MDANRPYLVLGLDPGIASCGFCLLDMTNHKILEMGSHLFKAPQEDKTKVSLAVTRRNARSIRRNTARTAARLKHCLSLLVEADLVPPDADRAWFQTKKGDKPVLKLRATGLDRLLTDREFAQALYSLCGRRGYIPRGEGRLGEADDNDNEGKRVLDAIKKNQEAMEAGAYRTVGEMLNAQGRSRNRGGDYSLCVYNSQVQDEVKTLFKEQRALGNAKATKKLEQAYIDCLTWEKKSLDHDARVYELVGECVYFPEEKRAASADISSELCRAYERLGHLAIVREDGSDQALSAEQIAHYLGILFSTAPIKGNKDCKVTYGTIRKDLDISGKDVFKGVAQDKEKDEVFAPKAWRCLRRTLPQGLLERMFDDRKLGDAVCEALTFASSEASLVERLSGLELSDDEAEAILEVPFTGKLFKGYGSRSLKTLGLLLGAFEEPEIRILTDAEKATGLLDLRLSDRGVRGGLLPPYDEYDRTCRNPVVLRAMGRMRHIVNAIIRIHGVPDEIHIELGRDLKMSNKEKDLVDKRNRENEAAKKKWAKTAADILGIEPEEVPGRIVRKLIMREEQDNWDLYTGDAIDLERLVRDDRYCEIDHILPYSRTCDDSRANKVLVLSKSNQDKRERTPYEWMTSGEAGAPSWDEYRARVMALVKNPHKRANHLNTDLGEEAQAKFLARNLNDDRYMSVAVKNYLEDCLLFPEDGRKRHVTAVAGGATGNLRWVWGLNFGSGNVKDRDDDRHHAVDAAIIAACSEGTVQKVAKASSKGREAFKHLRESRLADTQPWPTFADEVIARREFVVPTRMVDHGVTGRVFEDTLYHLEGITEDKGKYPLVRAGEKVAKQGNVHVNPDGSVKLIDGMAFLRLWLDPTARPNGKVKGKWYAEPVYYADIPAIKAGTYVPRACTIHVARVNWKPVPEAAAQQKPVVLYPGDVLQVGSHVGRYRSFDISNCGLSVNSLVNKDVIAPGFPKTLGGWGKDTQVRVLQEDCLGNCYDHIAINPDDSTFRQR

SEQ ID NO: 730 - protein, 1000 aa, unidentified
  REGION 1..1000: note = Description of Unknown: uncultivated organism with predicted taxonomy: Olsenella sp. KH3B4
  REGION 1..1000: note = MG14-54 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDKPFAPKAWRSLRRVLPERLLARMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKAREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYADIPAIKAGAYVPRACTIHVARVNWKPVPEAAMQIEPIMLYAGDVVEINNQLVRYSGFDINGATLYYQSLLNGATTTAIPSLGTWGKDTQVRVLQEDCLGHCYDGIAINPEDSTFQQR

SEQ ID NO: 731 - protein, 1026 aa, unidentified
  REGION 1..1026: note = Description of Unknown: uncultivated organism with predicted taxonomy: Collinsella
  REGION 1..1026: note = MG14-55 effector
MAAFEDPRELGFDTELVKTALMTREQFSSKPRKLVLGIDMGIAGIGICLMDKLNQEIVLMATHLFDCPWNPKNKTSLASARRQARSQRRNTARRAARKKHIREILMARGVIPEGVTAEWFSVRKGEQDNIQLRVKGLSEILSSRELARILYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISPLTRNQIVHDLFKVSKNPKPLKWSQLRKKLDLADTDTFAGVRQSDEAKDVCVKVPAWNVLCSTLHDLNPALLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHERKLITSGNIYNRRTNEKAKDDIVEYLGLSDADQVRGRDIDKVRLYNEQGGKDPYTGQGIDFGRMLTEKGYVEIDHILPFSRSCDNARTNKVLVLTKSNRNKSNRTPYEWMTSGEPTAPNWDEFCIRMDVWASGKEPKHYYSSKLAKLKEDNFTNNIDSFISRNLNDTRYMSKDVAKWLADCLPFPEDGRKHVFCVSGAATAFMRGIWRIGILDDVGKKNREDDRHYAVDAAVIAACTSSIVKGIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESAARWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 732 - protein, 1003 aa, unidentified
  REGION 1..1003: note = Description of Unknown: uncultivated organism with predicted taxonomy: Collinsella
  REGION 1..1003: note = MG14-56 effector
MEITINREIGKLGLPRHLVLGMDPGIASCGFALIDTANHEILDLGVRLFDSPNHPKTGQSLAVIRRGFRSTRRNIDRTQARLKHCLQTLKAYGVIPQDATKEYFHTTKGDKQPLKLRVQGLDRPLSNREWALVLYSLCKRRGYIPHGEGSQDKSSEGGKILSALAANKEALAETPCRTVGEWLAQQPQSRNRGGNYDKCVTHAQLIDETHILFEAQRSFGSAYASPEFEAAYIEVCDWERSRKDFDRRSYDLVGRCSYFPAEKRAARCTLTSELVAAYGALGNITVIHEGGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPRRAKDEIAKANKKNEKNRERIARQIAELRGCTADEVTGKQIEKYRLWEEQECFDLYTGAKIEVGRLISDDTYTQIDHILPFSRTGENSRNNKVLVLAKSNQDKREQTPYEWMSHDGAPSWDAFERRVQENQKLGRRKKNFLLEKDLDTKEGEFLARSFTDTAYMSREVCAYLADCLLFPNDGAKAHVVPTTGRATAWLRRRWGLNFGLTGEKDRSDDRHHATDACVIAACSPSLVIKTAQINQKMHWSMTKGMSKAQRQDAIMKALENVMPWETFANEVRAVHKLIIPTRFVPRKGKGELFEQTVYRYAGVDAKGKNLARRANSTEDIVMGNAVVSDDEKSIIKISEMLCLRLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKFRSPTVNKLSNDLSPLVIREPPIR

SEQ ID NO: 733 - protein, 1000 aa, unidentified
  REGION 1..1000: note = Description of Unknown: uncultivated organism with predicted taxonomy: Olsenella
  REGION 1..1000: note = MG14-57 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILAVPFTGKLFKGYGSRSLKALGLLLGAFEEPEIRILTDAEKVTGLLDLRLSDRDVRGQLLPPYSSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNFLEDRLLFPEDGRKRHVTAVAGGATGSLRWVWGLNFGEGNIKDRTDDRHHAVDAAIIAACSESTVKKVAEASAKGREAFKQLRKSRLADTQPWPSFAAEAAARREFVVPTRMADHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMEIEPVVLYAGDVVEINNQLVRYSGFNIRGATLYYQSLLNGATTTAIPSLGSWGKDTQVRVLQEDCLGHCYDGIAINPEDSTFQQR

SEQ ID NO: 734 - protein, 1003 aa, unidentified
  REGION 1..1003: note = Description of Unknown: uncultivated organism with predicted taxonomy: Collinsella
  REGION 1..1003: note = MG14-58 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 735 - protein, 1003 aa, unidentified
  REGION 1..1003: note = Description of Unknown: uncultivated organism with predicted taxonomy: Collinsella
  REGION 1..1003: note = MG14-59 effector
MEITINREIGKLGLPRHLVLGMDPGIASCGFALIDTANHEILDLGVRLFDSPTHPKTGQSLAVIRRSFRSTRRNIDRTQARLKHCLQVFKAYGLIPQDATKEYFHTTKGDRQPLKLRVDGLDRPLSAREWALVLYSLCKRRGYIPHGEGNQDKSSEGRKVLSALAANKEAIAETSCRTVGEWLAQQPQSRNRGGNYAKCVTHAQLIEETHILFDAQRSFGSKYASPEFEAAYIEVCDWERSRKDFDRRTYDLVGHCPYFPTEKRAARCTLTSELVSAYGALGNITIIHENGTSRALNATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRSNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENVMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 736 - protein, 1003 aa, unidentified; identical to SEQ ID NO: 732
  REGION 1..1003: note = Description of Unknown: uncultivated organism with predicted taxonomy: Collinsella
  REGION 1..1003: note = MG14-60 effector

SEQ ID NO: 737 - protein, 1004 aa, unidentified
  REGION 1..1004: note = Description of Unknown: uncultivated organism with predicted taxonomy: Collinsella
  REGION 1..1004: note = MG14-61 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLGRLLNDREWALVLYSLCKRRGYIPHGEGNQDKSSEGGKVLSALAANKETIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRALRNTLNAANPILLQRLRDDHDLADAVMEAVAYSSALPVLQEQLQGLPLSEAEIEALCRLPYSSKALNGYGNRSKKALDMLLDCLEEPEVLNLTQAENDCGLLGLRIAGSQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPDSLLIQKPLEIYLGDLIRVGDKLGRYNGYNIAKANWSFVDALTKKEIAFPSVGMLSNELRPIVIRKSILDN

SEQ ID NO: 738 - protein, 1003 aa, unidentified
  REGION 1..1003: note = Description of Unknown: uncultivated organism with predicted taxonomy: Collinsella
  REGION 1..1003: note = MG14-62 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKFASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALENVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 739 - protein, 1046 aa, unidentified
  REGION 1..1046: note = Description of Unknown: uncultivated organism with predicted taxonomy: Collinsella
  REGION 1..1046: note = MG14-63 effector
MDKAPGTDIGELGFDPGAFATALMTPEEFRSKDRVIWAGIDIGVASTGLCLVDILNHEIVLMASHLFKSPVVDKKKATAAPESLASVRRSARSVRRNIMREGRRKKAIRAVLADFGLIPADAGGEWFSARRDERTVVRLRSKALGYLLNPRELARVLYSFASHRGYIDHGKSDKEDDAGKVKKALAANRAELADGGCETFGQYLAAQPRSRNRAGDYSYTADIGMTVDEVRTIFARQRELGSEIASEALENRYIAELTWLTDTSKRDMSTYLKVGFCTYRGAPYRRGATSTISFEMVRAHQTLCNTVIQHADGTSSSIPGDTRIEIVRELFAVKKSVKPLKWSGLRRRLGLSEGDSFKGRPLEEEKRDCIALPAWAVLCSGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGEADDGLLCAFSDYDPTCKNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGVGIDFRRMLEEHGYAEIDHILPVSRTCDDSQANKVLCLTKSNRDKSNRSPYEWMTSGEASAPDWNGFCGRMERWAKMCEPRRYARKKLANLTCENLAERAGNFIDRNLNDTRYMSVALAKWLMECLPFAKDGHEHVFCVAGGATALMRSVWNIGITGPDGKKNRDDDRHHAVDAAVIACCTPGIVKNVALVNEGHARADVRQRLFRDSLPYPEFKEQVDAWIPCIVPTLTLPSTVTGSVLKDTVYPYLGRDEAGKDLYLTVNRDKDGRIVERKVNKATTMWKDGHGGCRKYDEMCALDAVFDASVGKRGKWAFDPVYCIDIPHRDAERRTMRAFSKEKAIDLWDTVEVPEDALRMTIRRGDVLVCDGKAARFHGFNISDNTIKLFPQRVGKQLQETGPLSDEAFPSPSKWGDGIRVMQEDCLGLCWLSFLAQRAAVTQTE

SEQ ID NO: 740 - protein, 1003 aa, unidentified
  REGION 1..1003: note = Description of Unknown: uncultivated organism with predicted taxonomy: Collinsella
  REGION 1..1003: note = MG14-64 effector
MASTVNREIGKLGLPRHLVLGMDPGIASCGFALIDINNHEILEIGVRLFDSPTHPKTGQSLAVIRRGFRSTRRNIDRTQARLKHCLEVLEKYDVIPQDATKEFFHTTKGDKQPLKLRVEGLDRLLTNREWALVLYSLCKRRGYIPHGEGSQDKSSEGGKVLSALAANKEAFAETSCRTVGEWLAQQPQSRNRGGNYDKCVTHAQLIEETRVLFEAQRSFGSQYASAELEEAYVQVCDWERSRKDFDRRSYDLVGYCTYFPTEKRAARCTLTSELVAAYGALGNITIVHEDGTTRTLTTAERDKCIAILFSCEPIRGNKDCAVKFGALRRELDLNSGDYFKGVPAADEKTREVYKPKGWRALRNTLNTTSPFLLRRLYDDRDLADSVMEAVAYSSALPVLEEQLQALPLSPAEIDALCKLPYSSKALNGYGNRSKKALDMLLDCLEDSEVLGLTQAEDDCGLLGLRIQGSQLERSERLMPYEMWVELTGRTNNNPVVIRSMSQMRKVVNAICRKWGVPNEIHIELDRELRLPQRAKDDIAKAHKRNEKNRERIAGQIAELRGCSPEDVSGRLIEKYRLWEEQECFDLYTGAKIEVDRLISDETYTQIDHILPFSRTGENSPSNKVLVLAKSNQDKREQTPFEWMSKEGAPSWDAFKRRVEENQKLGRRKKNFLLEENLEAKEGEFLARSFTDTAYMSREVCAYLADCLLFPEDGTKSHVVPTTGRATAWLRRRWGLNFGINGEKDRSDDRHHATDACVIAACSRSLVIKTAKISEQTHWAVTKDLDKDERDHLRMKALENVMPWETFANEVRASHDFVIPTRFVPHKGKGELFEQTTYRYAGVNSEGKDLARRANSDQDIVMGNAIVSDDGKSIIKVSEMLCLRLWHDPEAKKGQGCWYADPVYKADIPALKDGTYMPKIAKARTGRKAWKPVPECAMRHAPLEIYLGDLVKIGDFIGRFSGYNIANANWSFTDRLTRQKLSCPTVGKLNNALIPVIIRESSIR

SEQ ID NO: 741 - protein, 1003 aa, unidentified; identical to SEQ ID NO: 732
  REGION 1..1003: note = Description of Unknown: uncultivated organism with predicted taxonomy: Collinsella
  REGION 1..1003: note = MG14-65 effector

SEQ ID NO: 742 - protein, 1004 aa, unidentified
  REGION 1..1004: note = Description of Unknown: uncultivated organism with predicted taxonomy: Collinsella
  REGION 1..1004: note = MG14-66 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYLHTTKGDKQPLKLRVDGLDRLLNDREWALVLYSLCKRRGYIPHGEGNQDKSSEGGKVLSALAANKEAIAETSCRTVGEWLAWQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPFSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREACAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSLDEKSVIKVSEMLCLRLWHDPEAKKGQGAWYADPVYKADIPALKDGTYVPRIAKAHTGRKAWKPVPESAMKKPPLEIYLGDLVQIGDFMGRFSGYNIANANWSFVDRLTKEALGCPTVVKLDNKLAPAIIRESIIMH

SEQ ID NO: 743 - protein, 1003 aa, unidentified; identical to SEQ ID NO: 734
  REGION 1..1003: note = Description of Unknown: uncultivated organism with predicted taxonomy: Collinsella
  REGION 1..1003: note = MG14-67 effector

SEQ ID NO: 744 - protein, 1005 aa, unidentified
  REGION 1..1005: note = Description of Unknown: uncultivated organism with predicted taxonomy: Collinsella
  REGION 1..1005: note = MG14-68 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 745 - protein, 1000 aa, unidentified
  REGION 1..1000: note = Description of Unknown: uncultivated organism with predicted taxonomy: Olsenella
  REGION 1..1000: note = MG14-69 effector
MAEPYLVLGLDPGISSCGFALLDMNNHKILEMGSHLFDAPQDSQTKVSLAVGRRSARSARRNNLRTKNRQKHCMELLQEAGLVPQGVTKQWFQSTKGDRPLLELRFAALERPLTNREFAQVLYALSARRGYIPHGEGRISKLSDMDTSGSSDAEAGKVLKAIGENNKLMAQGHFRTVGEMLYDQGKSRNKGGSYERCVLNSQIVDEVHIIFQSQRTQQNTAATQELEAQYVQNLTWEKRTLDHDAKVHALVGKCSYFPGEFRAARADLSSELCNAYERIKHLRIVNADGDEVALAPEQVETYIAILFSPEPLKGKKEKVTYARIRKDLDLSAHLFFKGIDPEDEKDHEPYVPKAWRAMRKVLSTELMERLRSDRTLADAVGEALTYASSEDSLVYQLDNLDLSDEERSQILGLPFSGKIFKGYGSRSLKALDMLVDAFEEPEVTTLAEAEESSGLLGLRMSDRGARYPLLPSYSNYDKENRNPVVLRAMGRMRRIVNAIIRIYGVPDEIHVELGRDLKRSKHEKDLINKRNRENERKNKQWRAQIAEEQGIDPDEVRPKLLRKIALWEEQDNFDIYTGHKIEFDRMISDDKYCEIDHVLPYSRTCDDSRNNKVLVLAKSNQDKRERTPYEWMTQDARKGAPNWDEYQARVIANHHISPRKRRYLLDNNLGPDQESDFLSRNLNDDRYMSREVKSYLEDTLIFPEDGRVKHVIAVAGGATGSLRHVWGLNFGANNSKDRSDNRHHAIDACVIAACSESTLQAVAKARKLGAETYKRMRKDRLKDTQPWPTFADEVIARREFVIPTHMVSHGVTGRAFEDTNYRFDGITNDTKKLGILYGNGKTTKKGNFVIGNDGNAHLVDGMAFLRLWLDPTARKGKGKWYAEPVYYADIPAIKNGTYIPRAAKAHVARVAWEPVPENALASAPVVLFSDNVIKVGSAIARYSRFDIGNAALVLENLRTGEECKKFPTLGRWNNELVPIIINEDCLGHCYKELAPNILEG

SEQ ID NO: 746 - protein, 1026 aa, unidentified
  REGION 1..1026: note = Description of Unknown: uncultivated organism with predicted taxonomy: Collinsella tanakaei
  REGION 1..1026: note = MG14-70 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERVFADAGYRTVGEWLASLPQSRNRGGNYDKCVTHAQLTDEVRTLFEAQRGFGSPVASQELEDAYIEVFDWERSREEFDKRAYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 747 - protein, 862 aa, unidentified
  REGION 1..862: note = Description of Unknown: uncultivated organism with predicted taxonomy: Collinsella
  REGION 1..862: note = MG14-71 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGAFGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPAVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVISACSRSLVIKTARINQETHWSITRGMNETQRRDAIMKALESVMPWETFANEVRAAHDFVVPTRFVPRKGKGELFEQTVYRYAGVNAQGKDIARKASSDKSDGAG

SEQ ID NO: 748 - protein, 895 aa, unidentified
  REGION 1..895: note = Description of Unknown: uncultivated organism with predicted taxonomy: Atopobium sp. ICM42b
  REGION 1..895: note = MG14-72 effector
YINRGEETLINGEVSTEVSSESEEAGKVLSAISENKKALKESGYRSFGEYLYKESYVSTRSYRNKAGDYKHCVSHPMVVDEIKELFEQQKKFGNTHTSEEFKYAYLEQLNWLKDTKAFDKLTYQKVGYCVYFDQYSDEPQKRSANADLISEVVKAYEKLGNIRLKFDDKPEQSLTREVRDAVINEMFSVHQGAKVKSVTYKTLRKLIDDDNLIGFKGVKSDLEKNPVFVPKAWNTFCRVLSGSESGIQLLNRMRSDFKFANAIAESLTYASSLDSLERRISMYQEKEDLVISEDELALIESLPYNTKIFKGYGSRSVQALEMLHDQFSDGEAFTLDEAEKQSGLQGFRLREKGIRQSLLPPYSDYDVQCTNPVVLRVLAQARRMINSAIKQYGMPNIIRIELGNDIAKSAKEKSKIAKGQNENRKENERIKDKIAEILHIDQSEVTGKQITKMKLYEEQGGKDIYTGEGLGDIAFAGGRRFLIDDNYCEIDHVLPYSRSADDLKSNKVLVLAKSNQEKGNRTPYEWMNSNDGSHPNWEQFCLRVLSNVRLSDGKKSKLLEENFAEKEVSFIKRNMVDTQYMARAISAWLSDSLNFSTEFNQKQHVYAVNGRMTAKLRRKWGLNFGEDDTKDRSDNRHHAIDAAVIAVCSASMVKEFAISYSRLREVRDSVIAEPWEGFADQVREAREWVIPTMYRPNKKNGLLFEESRYRYVEKKKKHILTSKDGKEKSSGNIRFFENEKDGRHVKIVGNIAYIRLWLDENARKGKGEWLIEPVYFVDLQSIKNGSYVPRYISASHVTSDEWKSIPEEVLSKIPPVVIHIQDVIQVDSSYFRVDGVDIDAKALNLMPVFSDSNNSDPALAKMSKWNKSTEVTRISEDALGLVWFNYLKNQNSSES

SEQ ID NO: 749 - protein, 1003 aa, unidentified
  REGION 1..1003: note = Description of Unknown: uncultivated organism with predicted taxonomy: Collinsella
  REGION 1..1003: note = MG14-73 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNTANPILLQRLRDDRNLADAVMEAVAYSSALPVLQEQLQGLPLSEAEIEALCRLPYSSKALNGYGNRSKKALDLLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDSKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 750 - protein, 1026 aa, unidentified
  REGION 1..1026: note = Description of Unknown: uncultivated organism with predicted taxonomy: Collinsella
  REGION 1..1026: note = MG14-74 effector
MAAYEDPRDCGFDPELVKTALMSREQFGSKPRKLVLGIDMGIAGIGICLMDKLNQEIVLMATHLFDCPWNPKNKTSLASARRQARSQRRNIARRTARKKHIREILMARGVIPEGVTAEWFSVRKGEQDNIQLRVKGLSQILSSRELARVLYGFASRRGYIDHGKADNDKDAGKVKKALKENAEIMDANGYETFAQYLVTQPRIRNRQNDYSHTIDIDMVVDEVHAIFRHQRELGNELATESLEGEYLAALRWLTDTTKRDRIIYSKVGYCTYLGEPIRRGPKSSISSEMVRAYQTLANVKIEHIGSVATHISLLTRNQIVHDLFKVSKNPKPLKWSQLRKKLDLADTDTFAGVRQSDEAKDVCVKVPAWNVLCSTLHDLNPTLLNRLHDDVDLADAVCAAATFASSSESFATRIAERTDGLKQEDMEALLELPYGSKLFTGYGSTSLKALQMLRDAFEDTNINRLYDAEVATGLYDAREALAAKRNASDDGLLMPYSKYSPICTNPVVLRSCAQMRRIINSIIRHYGLPDTIRVEVANDLKRTEHEKKLITSGNIYNRRTNEKAKDDIVEYLGLSEADQVRGRDIDKVRLYNEQGGKDPYTGQGIDFGRMLTEKGYVEIDHILPFSRSCDNARTNKVLVLTKSNRDKSNRTPYEWMTSGEPTAPNWDEFCIRMDVWASGKEPKHYYSSKLAKLKEDNFTNNIDSFISRNLNDTRYMSKDVAKWLADCLPFPEDGRKHIFCVSGAATAFMRGIWRIGILDDAGKKNREDDRHYAVDAAVIAACTSSIVKDIALISEEHATNRDADRLLDGSLPYPEYRDQVKAWIPCIVPTYSPTRTATGALFKENTFSYKGIDGKGKDLIKKKKGALGPCTTAWKDGKGTARAYDEQYSLLAVYEESASRWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 751 - protein, 1046 aa, unidentified
  REGION 1..1046: note = Description of Unknown: uncultivated organism with predicted taxonomy: Collinsella sp. AM13-34
  REGION 1..1046: note = MG14-75 effector
MDKAKGADIGELGFDPATFATALMTLEEFRSKDRVIWAGLDIGVASTGLCLVDVRNHEIVLMASHLFKSPVVDKKKATAAPESLASVRRGARSIRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYENHRDLLERLHDHIDDADAVCSALTFASSAASLTGRLAPLALSDDEVEAIIDLPYSARLFSGYANASLEALQMLRGTFEDPRVTSLRQAEEDSGLAQARAILAEERGGSADGLLCAFSDYDPTCRNHVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKVLCLTKSNRDKSNRSPYEWMTSGEASAPDWGEFCGRMERWAKMCEPRRYARKKLANLTCENLTERAGNFIDRNLNDTRYMSVALAKWLRECLPFAKDGHEHVFCVAGGATALMRSVWNIGITGPDGKKNREDDRHHAVDAAVIACCTPGIVRNVALVNEGHARADVRQRLFSDSLPYPEFKEQVDAWIPCIVPTLTLPNAVTGSVLKDTVYPYLGRDEAGKDLYLTVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQTTGPLSAEAFPPPSKWGEGVRIMQEDCLGLCWLSFLAQRAADVQME

SEQ ID NO: 752 - protein, 1003 aa, unidentified
  REGION 1..1003: note = Description of Unknown: uncultivated organism with predicted taxonomy: Collinsella
  REGION 1..1003: note = MG14-76 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 753 - protein, 1003 aa, unidentified
  REGION 1..1003: note = Description of Unknown: uncultivated organism with predicted taxonomy: Collinsella
  REGION 1..1003: note = MG14-77 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKTNKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 754 - protein, 1004 aa, unidentified
  REGION 1..1004: note = Description of Unknown: uncultivated organism with predicted taxonomy: Collinsella
  REGION 1..1004: note = MG14-78 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWELNFGSNREKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 755 - protein, 1003 aa, unidentified
  REGION 1..1003: note = Description of Unknown: uncultivated organism with predicted taxonomy: Collinsella
  REGION 1..1003: note = MG14-79 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 756 - protein, 1003 aa, unidentified
  REGION 1..1003: note = Description of Unknown: uncultivated organism with predicted taxonomy: Coriobacteriales
  REGION 1..1003: note = MG14-80 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFARRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 757 - protein, 1004 aa, unidentified
  REGION 1..1004: note = Description of Unknown: uncultivated organism with predicted taxonomy: Collinsella
  REGION 1..1004: note = MG14-82 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSDLPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 758 - protein, 1003 aa, unidentified
  REGION 1..1003: note = Description of Unknown: uncultivated organism with predicted taxonomy: Collinsella
  REGION 1..1003: note = MG14-83 effector
MTSTVNREIGKLGLPRHLVLGMDPGIASCGFALIDINNHEILEIGVRLFDSPTHPKTGQSLAVIRRGFRSTRRNIDRTQARLKHCLEVLKKHGVIPQDATKEFFHTTKGDKQPLKLRVEGLDRMLTSREWALVLYSLCKRRGYIPHGEGSQDKSSEGGKVLSALAANKEAIAETSCRTVGEWLAQQPQSRNRGGNYDKCVTHAQLVEETHILFEAQRNFGSQYASAELEEAYVQVCDWERSRKDFDRRSYDLVGYCTYFPTEKRAARCTLTSELVAAYGALGNITIVREDGTTRTLTAAERDKCIAILFSCEPIRGNKDCAVKFGALRRELDLNSGDYFKGVPAADEKTREVYKPKGWRTLRNTLNTISPFLLRRLHDDRDLTDSVMEAVAYSSALPVLEEQLQALPLSPTEIGALCKLPYSSKALNGYGNRSKKALDMLLDCLEDSEVLGLTQAEDDCGLLGLRTQGAQLKRSEHLMPYEMWVELTGRTNNNPVVIRSMSQMRKVVNAICRKWGVPNEIHIELDRELRLPQRAKDDIAKAHKKNEKNRERIAGQIAELRGCSPEDVSGKLIEKYRLWEEQEYFDLYTGTKIEVDRLISDETYTQIDHILPFSRTGENSPSNKVLVLAKSNQDKREQTPFEWMSKEGAPSWDAFKRRVEENQKLGRRKKNFLLEEDLEAKEGEFLTRSFTDTAYMSREVCAYLADCLLFPEDGTKSHVVPTTGRATAWLRRRWGLNFGTNGEKDRSDDRHHATDACVIAACSRSLVIKTAHISEQTHWTVTKNLDKDERNRLRMKALENVMPWETFANEVRASHDFVIPTRFVPRKGKGELFEQTTYRYAGVNDKGKDLARKANSDQDIVMGNAVVSEDGKSIIKVSEMLCLRLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 759 - protein, 1000 aa, unidentified
  REGION 1..1000: note = Description of Unknown: uncultivated organism with predicted taxonomy: Olsenella
  REGION 1..1000: note = MG14-84 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRASGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 760 - protein, 1003 aa, unidentified
  REGION 1..1003: note = Description of Unknown: uncultivated organism with predicted taxonomy: Collinsella
  REGION 1..1003: note = MG14-85 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIHNANWSFVDRLTRIKISCPTVGKLSNDMSPFVVRESPIK

SEQ ID NO: 761 - protein, 1003 aa, unidentified; identical to SEQ ID NO: 717
  REGION 1..1003: note = Description of Unknown: uncultivated organism with predicted taxonomy: Collinsella
  REGION 1..1003: note = MG14-87 effector

SEQ ID NO: 762 - protein, 1003 aa, unidentified; identical to SEQ ID NO: 717
  REGION 1..1003: note = Description of Unknown: uncultivated organism with predicted taxonomy: Collinsella
  REGION 1..1003: note = MG14-88 effector

SEQ ID NO: 763 - protein, 1002 aa, unidentified
  REGION 1..1002: note = Description of Unknown: uncultivated organism with predicted taxonomy: Collinsella
  REGION 1..1002: note = MG14-89 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 764 - protein, 1003 aa, unidentified
  REGION 1..1003: note = Description of Unknown: uncultivated organism with predicted taxonomy: Coriobacteriia
  REGION 1..1003: note = MG14-90 effector
MEITINREIGKLGLPRHLVLGMDPGIASCGFALIDTANHEILDLGVRLFDSPTHPKTGQSLAVIRRGFRSTRRNIDRTQARLKRCLQVFKAYGLIPQDATKEYFHTTKGDKQPLKLRVDGLDRLLSAREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCPYFPTEKRAARCTLTSELVSAYGALGNITIIHENGTSRALSATEHDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEENRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRRLVIKTARINQEMHWSMTKGMSKAQRQDAIMKALENAMPWETFANEVRVAHDFVVPTRFVPRKGKGELFEQTVYRYAGVNAQGKDIARKASSDKDIVMGNAVVSADEKSVIKVSEMLCLRLWHDPKAKKGQGAWYADPVYKADIPALKDGTYVPRIAKAHTGRKAWKPVPESAMKKPPLEIYLGDLVQIGDFVGRFSGFDIDNANWSFSDRLTRKKLRSPTVNKLSNDLSPLVIRESPIR

SEQ ID NO: 765 - protein, 1026 aa, unidentified; identical to SEQ ID NO: 746
  REGION 1..1026: note = Description of Unknown: uncultivated organism with predicted taxonomy: Collinsella tanakaei
  REGION 1..1026: note = MG14-91 effector

SEQ ID NO: 766 - protein, 1004 aa, unidentified
  REGION 1..1004: note = Description of Unknown: uncultivated organism with predicted taxonomy: Collinsella
  REGION 1..1004: note = MG14-92 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLCRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTGKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 767 - protein, 1003 aa, unidentified
  REGION 1..1003: note = Description of Unknown: uncultivated organism with predicted taxonomy: Collinsella
  REGION 1..1003: note = MG14-93 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 768 - protein, 1003 aa, unidentified
  REGION 1..1003: note = Description of Unknown: uncultivated organism with predicted taxonomy: Collinsella
  REGION 1..1003: note = MG14-94 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGRGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 769 - protein, 1046 aa, unidentified
  REGION 1..1046: note = Description of Unknown: uncultivated organism with predicted taxonomy: Collinsella
  REGION 1..1046: note = MG14-95 effector
MDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADTDGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRELFDVKRSVKPLKWSGLRRRLGLAECDSFKGRPAEEEKRDCIALPAWAVLCSGLYENHRDLLERLHDHIDDADAVCSALTFASSAASLAGRLAPLAITDDEVEAIIDLPYSARLFSGYANASLEALQMLRGTFEDPHVTSLRQAEEDSGLAQARAMLAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAGIDFRRMLEEHGYAEIDHILPVSRTCDDSQANKALCLTKSNRDKSNRSPYEWMTSGEASAPDWGEFCGRMERWAKMCETRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVKNVALVNEGHARADVRQRLFSDSLPYPEFKEQVDAWISCIVPTLTLPNTVTGSVLKDTVYPYLGRDEAGKDLYITVKRDKDGRIVERKVNKATTMWKDGQGGCRAYGSMCALEAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAADVQME

SEQ ID NO: 770 - protein, 1002 aa, unidentified
  REGION 1..1002: note = Description of Unknown: uncultivated organism with predicted taxonomy: Collinsella
  REGION 1..1002: note = MG14-96 effector
MEITINREIGKLGLPRYLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEASYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENGCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDNRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 771 - protein, 1002 aa, unidentified
  REGION 1..1002: note = Description of Unknown: uncultivated organism with predicted taxonomy: Collinsella
  REGION 1..1002: note = MG14-97 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLNRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTLIRELLI

SEQ ID NO: 772 - protein, 1003 aa, unidentified
  REGION 1..1003: note = Description of Unknown: uncultivated organism with predicted taxonomy: Collinsella
  REGION 1..1003: note = MG14-98 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGCKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAANEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDDAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNEAQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKQPLEMYLGDLVQIGDFVGRFSGYNIDNANWSFVDRLTRIKISCPTVGKLSNDMSPFVVRESPIK

SEQ ID NO: 773 - protein, 1002 aa, unidentified; identical to SEQ ID NO: 685
  REGION 1..1002: note = Description of Unknown: uncultivated organism with predicted taxonomy: Olsenella
  REGION 1..1002: note = MG14-99 effector

SEQ ID NO: 774 - protein, 1004 aa, unidentified
  REGION 1..1004: note = Description of Unknown: uncultivated organism with predicted taxonomy: Collinsella
  REGION 1..1004: note = MG14-100 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLCDDRNLADAVMEAVAYSSALPVLQEQLQGLPLSKAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 775 - protein, 1045 aa, unidentified
  REGION 1..1045: note = Description of Unknown: uncultivated organism with predicted taxonomy: Eggerthella sp. AM16-19
  REGION 1..1045: note = MG14-101 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAVQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWNIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMPEDCLGLCWLSFLSNRAIAQMD

SEQ ID NO: 776 - protein, 1000 aa, unidentified
  REGION 1..1000: note = Description of Unknown: uncultivated organism with predicted taxonomy: Olsenella sp. KH3B4
  REGION 1..1000: note = MG14-102 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTAGEIDDYLKILFSTAPIKGNKECKVTYGTIRKDLDISGKSVFKGIAQDKEKDEPFAPKAWRSLRRVLPERLLASMLEDRNLGDAVCEALTFASSEASLIERLSDLDLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKTLVLSKSNQDKRERTPYEWMTSGEAGAPSWDSYRARVMAQVKNPRKRANYLNTDLGPETQAKFLARNLNDDRYMSVAVKNFLEDRLLFPEDGRKRHVTAVAGGATGNLRWVWGLNFGEGNIKDRTDDRHHAVDAAIIAACSESTVKKVAKASAKGREAFKQLRKSRLADTQPWPTFAAEVAARREFVVPTRMADHGVMGRVFKDTLYHLEGITEDKGKYPLVRAGEKTVKKGNVRINPDGSVKLIDGMAFLRLWLDPTARPNGKVKGKWYAEPVYYVDIPAIKAGAYVPRACTIHVARVNWKPVPEEAMQIEPIMLYAGDVVEINNRLVRYSGFDINGATLYYQSLLNGATTTAIPSLGTWGKDTQVRVLQEDCLGHCYDGIAINPEDSTFQQR

SEQ ID NO: 777 - protein, 1003 aa, unidentified
  REGION 1..1003: note = Description of Unknown: uncultivated organism with predicted taxonomy: Collinsella
  REGION 1..1003: note = MG14-103 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 778 - protein, 1003 aa, unidentified
  REGION 1..1003: note = Description of Unknown: uncultivated organism with predicted taxonomy: Collinsella
  REGION 1..1003: note = MG14-104 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQKPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICHKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHVPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 779 - protein, 1005 aa, unidentified; identical to SEQ ID NO: 695
  REGION 1..1005: note = Description of Unknown: uncultivated organism with predicted taxonomy: Collinsella
  REGION 1..1005: note = MG14-105 effector

SEQ ID NO: 780 - protein, 1003 aa, unidentified; identical to SEQ ID NO: 728
  REGION 1..1003: note = Description of Unknown: uncultivated organism with predicted taxonomy: Collinsella
  REGION 1..1003: note = MG14-106 effector

SEQ ID NO: 781 - protein, 965 aa, unidentified
  REGION 1..965: note = Description of Unknown: uncultivated organism with predicted taxonomy: Collinsella
  REGION 1..965: note = MG14-107 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNID

SEQ ID NO: 782 - protein, 1027 aa, unidentified
  REGION 1..1027: note = Description of Unknown: uncultivated organism with predicted taxonomy: Atopobium sp. ICM42b
  REGION 1..1027: note = MG14-108 effector
MSKSDRGLVFGIDLGKASCGLAIIDYEAKEVKLLSSRIIKAPENRSGKSLAAVRREKRSIRRQIDRRAARKKNVLKVLKQFGITPQDCDCKWFETKKNGNDGIDLPVIVLRSQGLDRQLSNREWARILYWFCSQRGYINRGEETLINGEVSTEVSSESEEAGKVLSAISENKKALKESGYRTFGEYLYKESYVSTRSYRNKAGDYKHCVSHPIVVDEIKELFEQQKKFGNTHTSEEFRDAYLEQLNWLKDTKAFDKLTYQKVGYCVYFDQYSDEPQKRAANADLISEVVKAYEKLGNIRLKFDDKPEQSLTREVRDAVINEMFSVHQGAKVKSVTYKTLRKLIDDDNLVGFKGVKSDLEKNPVFVPKAWNTFCRVLSASESGIQLLNRMKNDFKLANAIAESLTYASSLDSLERRISMYQEKESLEISEDELALIESLPYNIKIFKGYGSRSIQALEMLHDQFLGGKAFTLDEAEKQSGLQGFRLREKGIRQSLLLPYSDYDVQCTNPVVLRVLAQARRMINSAIKQYGMPNIIRIELGNDIAKSAKEKSKIAKGQNENRKENERIKDKIAKLLHIDQSEVTGKQITKMKLYEEQGGKDIYTGESLGDIAFAGGRRFLIDDNYCEIDHVLPYSRSADDLKSNKVLVLAKSNQEKGNRTPYEWMNSNDGNHPNWEQFCLRVTSNVRLSDSKKSKLLEENFAEKETSFIKRNMVDTQYMARAISAWLSDSLNFSSEFDQKQHVYAVNGRMTAKLRRKWGLNFGEDDTKDRSDNRHHAIDAAVIAACSASMVKEFAISYSRLREVRDSVIAEPWEGFADQVREAREWIIPTMYRPNKKNGLIYEETKYKYLGKEVGDKKIVHILKGKKQGVGTVDLFRDPTGGQFARILGDRAYIRLWLDEEGKSGRGEWLIEPVYFADLDKIKRGSYVPRYIPRQKVTTQEWESIPSRITENSIPIVLRNDDIVRIDGIYGRLSGLDINSKRLKFDRILSKDVKTIGSWTKDTSVEVIHEDCLGLMWFNLLKDQNSKES

SEQ ID NO: 783 - protein, 1031 aa, unidentified
  REGION 1..1031: note = Description of Unknown: uncultivated organism with predicted taxonomy: Atopobium sp. ICM42b
  REGION 1..1031: note = MG14-109 effector
MSKSDRGHVFGVDLGKSGNGLASIDYENKDINFLSSRPFKAPENRAGKSLAKVRREARSIRRQLDRKSTRKKQIIKVLKQFSVIAQECDSRWFETKKNGNGGIDLPIIILRSQGLDRKLTNREWARVLYWFCSQRGYINRGEEALSNEEASVEDSSESDEVGKVLSAISDNRKALKKSGYRTFGEYLFKESYEITRSYRNKNGEYRHCVSHPMVVDEINELFKHQQKLGNTYTSEEFREAYLRQLNWLKDTMAFDKLTYQKVGYCVYFDQYSDEPQKRAANADLISEVVKAYEKLGNIRLKFDDKSEQNLTKEVRDAVINEMFSIHQGSRVKSITYKTLRKLIDNENLIEFKGIKSDLEKSSVFAPKAWNFYCRALSISESGLQLLNRMKSDFKFANVISESLTYATSLESLESRILMYQDKESIEISEEELTLIESLPYNSKIFKGYGSRSIEALEMLYDQFTEGEAFTLDEAEKQSGLQSFRLRDKGIKQRLLPPYSDYDPQCTNPVVLRSLSQARKMINSGIKQFGMPDIIRVELAKELTKSPKQREKIAKEQNKNRKENERIRKEIAKYLEIDSSCVTKKQILKKKLYEEQKGLDVYTGESLEPSLHADDLTYLKDDSYCQIDHILPYSRSADDSIANKVLVLAKSNQDKGNRTPYEWMTSGHEHHLSWEEFAIRVSTNLSISDSKKWRLLEEDFNKKEVQFMNRNLSDTQYMSKAIVAWLSDSLDFPSRYGQKQHVYATNGRMTSKLRKEWGLNFGENGIKDRNDKRHHAVDAAVIAACSASMVKEFATSYSRSHETKNSTIAEPWEGFADQVREAREWVIPTMYRPNKKNGLLFEDRRYRYAGKTNKHILIGKEGKEKTSGNIRFFDNEKDGKHVKIVGDVAYIRLWLDVNAREGKGEWLIEPVYFADLQSIKKGTYIPKYIATYNATNDEWKPVPDDVLSKNKPLIVHRQDVIKVDSSFFRVNSVDIAKKTLKLIPVFYDSKNSNPELMITRKWDKSTKIELVYEDVLGMIWFNYLKNQNSSES

SEQ ID NO: 784 - protein, 1003 aa, unidentified; identical to SEQ ID NO: 717
  REGION 1..1003: note = Description of Unknown: uncultivated organism with predicted taxonomy: Collinsella
  REGION 1..1003: note = MG14-110 effector

SEQ ID NO: 785 - protein, 1037 aa, unidentified
  REGION 1..1037: note = Description of Unknown: uncultivated organism
  REGION 1..1037: note = MG14-111 effector
MEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFADRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGESLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKHEKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 786 - protein, 1004 aa, unidentified
  REGION 1..1004: note = Description of Unknown: uncultivated organism with predicted taxonomy: Collinsella
  REGION 1..1004: note = MG14-112 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRGAIMKALESVMPWETFANEVRAAHGFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 787 - protein, 1002 aa, unidentified; identical to SEQ ID NO: 771
  REGION 1..1002: note = Description of Unknown: uncultivated organism with predicted taxonomy: Collinsella
  REGION 1..1002: note = MG14-113 effector

SEQ ID NO: 788 - protein, 1002 aa, unidentified
  REGION 1..1002: note = Description of Unknown: uncultivated organism with predicted taxonomy: Collinsella
  REGION 1..1002: note = MG14-114 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQEAHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 789 - protein, 1003 aa, unidentified
  REGION 1..1003: note = Description of Unknown: uncultivated organism with predicted taxonomy: Collinsella
  REGION 1..1003: note = MG14-115 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVVYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIEVSKMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 790 - protein, 1002 aa, unidentified
  REGION 1..1002: note = Description of Unknown: uncultivated organism with predicted taxonomy: Collinsella
  REGION 1..1002: note = MG14-116 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFETAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCAADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSDGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPSLKDGTYVPKIAKAATGRKAWKAIPQNVLNSAPLEIYLGDLVQIGNQKGRFRGINIATVSWSFVDTLSKLPVKMPTIGRLNNETIPTVIRELLI

SEQ ID NO: 791 - protein, 1003 aa, unidentified
  REGION 1..1003: note = Description of Unknown: uncultivated organism with predicted taxonomy: Collinsella
  REGION 1..1003: note = MG14-117 effector
MEITINREIGKLGLPRHLMLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDHLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNEDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYLGDLVQIGDFVGRFSGYNIDNANWSFVDRLTRIKISCPTVGKLSNDMSPFVVRESPIK

SEQ ID NO: 792 - protein, 1000 aa, unidentified
  REGION 1..1000: note = Description of Unknown: uncultivated organism with predicted taxonomy: Olsenella sp. KCTC 15699
  REGION 1..1000: note = MG14-118 effector
MDVTRPYLVLGLDPGIASCGFCLLDMTNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASQIDDYLKILFSTAPIKGNKECKVTYGTIRKDLDISGKSVFKGIAQDKEKDEPFVPKAWRSLRRVLPERLLARMLEDRNLGDAVCEALTFASSEASLIERLSDLGLSDDERDAILAVPFTGKLFKGYGSRSLKALGLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGETSAPSWDSYRARVMAQVKNPRKRANYLNTDLGPETQAKFLARNLNDDRYMSVAVKNYLEDCLLFPEDGHKRHVTAVAGGATGNLRWVWGLNFGEGNVKNRADDRHHAVDAAIIAACSESTVKKVAEASAKGREAFKQLRKSRLADTQPWPTFAAEVAARREFVVPTRMADHGVTGRVFEDTLYHLEGITEDKGKYPLVRAGKNTVKKGNVRINSDGSVKLIDGMAFLRLWLDPTARPNGKVKGKWYAEPVYYADIPAIKAGTYVPRAIVQGIARINWEPIPQMALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 793 - protein, 1005 aa, unidentified
  REGION 1..1005: note = Description of Unknown: uncultivated organism with predicted taxonomy: Collinsella
  REGION 1..1005: note = MG14-119 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCGTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 794 - protein, 1026 aa, unidentified
  REGION 1..1026: note = Description of Unknown: uncultivated organism with predicted taxonomy: Collinsella tanakaei
  REGION 1..1026: note = MG14-120 effector
MESLVNREVGGLGKPRYLVMGMDPGIKSCGFALLDLNNQEILEMGSRLFDAPTHPKTKQSMAVIRRGYRSTRRNIDRTQDRLKHCLKTLKRFDVVPEDADKEFFHTVKGDKQPILLRTDGLNRLLTSREWALVLYSLCKRRGYIPHGEGSDSGTSEDGKVLAALKANERAFADAGYRTVGEWLASLPQSRNRGGNYDKCVTHAQLTDEVRTLFEAQRGFGSPVASQELEDAYIEVFDWERSREEFDKRTYGLVGTCSYFPNEKRAARCTLTSEMVAAYGALGNITIVKRDGSTHPLSAVERDQCIDILFAVDPMKGNKTCAVKYGFLRKRLDLESGDYFKGVPLDDEKNREVFKPKGWRSLRSVLHETNRELLVKLHDDRDLADAVMEAVAYSSSVDVLKSQLSSLDLSNGEIESICAMPYSSKVLNGYGNRSKKALDILLGCFEDPDVLSLTDAEDASGLGAVRMQGAAIDKGERLIPYETWIALTGRTNNNPVVIRALSQMRKVVNAVCRKWGVPDEIHVELDRELRLPKKAKDEIAKAKKRNEKDRQRVAAQIAELLGCSADDVKGDYIEKYRLWEEQECFDIYSGEKIEVDRLIREETYTQIDHVLPFSRTGDNSRHNKVLVLARSNQLKREQTPYEWMTSNTEGAPSWDAFKRRVEENKKLSRRKKNFLLEEDLVSKEGEFQSRNMTDTAYMSREVCAYLSDCLQFPDDGLKNHIVPIAGRATAWLRRQWGLNFGATGEKDRSDDRHHATDACVIAACSRSLVIKTAKVMKQTHWQVTRDMTREQRRSARMKALEGTMPWSTFANEVRERWKVTVPTRFVPRKGRGELYGQTVYSYLGVDESGKDLGRKKGSNKKIVMGNAVISKDGKSMVKISEMLCLRLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 795 - protein, 1004 aa, unidentified
  REGION 1..1004: note = Description of Unknown: uncultivated organism with predicted taxonomy: Collinsella
  REGION 1..1004: note = MG14-121 effector
MEITINREIGKLGLPRHLVLGMDPGIESCGFALIDTANHEILNLGVRLFDSPTHPKPGQSLAVIRRGFRSTRRNIDRTQARLKHCLQVLKAYDLIPQDATKEYFHTTKGDKQPLKLRVDGLDRLLNDREWALVLYSLCKRRGYIPHGEGNQDKSSEGGKVLSALAANKEAIAETSCHTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSAMERDECIAILFSCEPIRGNKDCAVKFGALRKALDLSSGDYFKGIPAADEKTREVYKPKGWRVLRNTLNAANPILLQRLRDDRDLADAVMEAVAYSSALPVLQKQLQGLPLSEAEIEALCRLPYSSKALNGYGNRSKKALDMLLDCLEEPEVLNLTQAENDCGLLGLRIAGAQLERSDRLMPYETWIEHTGRTNNNPVVIRSMSQMRKVVNAICRKWGVPNEIHVELDRELRLPQRAKDEIAKANKKNKKNRERIAGQIAELRGCTIDEVTGKQIEKYRLWEEQECFDLYTGAKIEVDRLISDDTYTQIDHILPFSRTGENSRNNKVLVLAKSNQDKREQTPYEWMSHDGAPSWGAFERRVQENQKLSRRKKNFLLEKDLDTKEGEFLARSFTDTAYMSREVCAYLADCLLFPDDGAKAHVVPTTGRATAWLRRRWGLNFGSNGEKDRLDDRHHATDACVIAACSRSLVIKTARINQETHWSITRGMNEAQRRDAIMKALESVMPWETFANEVRAAHDFVVPTRFVPRKGKGKLFEQTVYRYAGVNAQGKDIARKASSDKDIVMGNAVVSADEKSVIKVSEMLCLRLWHDPEAKKGQGAWYADPVYKADIPALKDGTYVPRIAKQNYGRKVWKAIPHSLLIQKPLEIYLGDLIRVGDKLGRYNGYNIAKANWSFVDALTKKEITFPSVGMLSNELRPIVIRESILDN

SEQ ID NO: 796 - protein, 1002 aa, unidentified
  REGION 1..1002: note = Description of Unknown: uncultivated organism with predicted taxonomy: Olsenella
  REGION 1..1002: note = MG14-122 effector
MDVTRPYLVLGLDPGIASCGFCLLDMTNHKILEMGSHLFKAPQEDKTKTSLAVTRRKARSIRRNTARTAARLKRCLELLAGAGLVPADADKTWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKVLFASQRAHGNTKATRELEDSYLACLTWEKKSLDHDARVYELVGPCSYFPGEKRAASADISSELCRAYERLGHIVIVHEDGSEQALTASEIDDHLKILFSTAPIKGNKECKVTYGTIRKDLDISGKSVFKGIAQDREKDEPFAPKAWRSLRRVLPEGLLARMFADRKLGDAVCEALTFASSEASLIERLSDLGLSDDERDAILAVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVMAQVKNPRKRANHLNTDLGPETQAKFLARNLNDDRYMSVAVKNYLEDCLLFPEDGRKRHVTAVAGGATGNLRWVWGLNFGEGNVKDRADDRHHAVDAAIIAACSESTVKKVAEASAKGREAFKQLRKSRLADTQPWPTFAAEVAARREFVVPTRMADHGVTGRAFQDFSYRLEGLRETGYAEISRQTDPATRERRSDAAGNYALSSNGTVKLLDAIAFVRFWHDPDAGKNGKWYAEPVYCADIPAIQNGSYVPKYQKQKVARNSWLPVPDSAMHNEPLVLFQGDVLIIDSHIGRFWTYAIGGGTLNILSLLDKNEKAECFPPISKWVNSVEVRVLQEDCLGHCYDDISINPEDSTFRQR

SEQ ID NO: 797 - protein, 1003 aa, unidentified
  REGION 1..1003: note = Description of Unknown: uncultivated organism with predicted taxonomy: Olsenella mediterranea
  REGION 1..1003: note = MG14-123 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKHASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKTSSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 798 - protein, 1005 aa, unidentified
  REGION 1..1005: note = Description of Unknown: uncultivated organism with predicted taxonomy: Collinsella
  REGION 1..1005: note = MG14-124 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVTYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 799 - protein, 1003 aa, unidentified
  REGION 1..1003: note = Description of Unknown: uncultivated organism with predicted taxonomy: Collinsella
  REGION 1..1003: note = MG14-125 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALADNKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKVEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVITVREMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 800 - protein, 969 aa, unidentified
  REGION 1..969: note = Description of Unknown: uncultivated organism with predicted taxonomy: Libanicoccus massiliensis
  REGION 1..969: note = MG14-126 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKC

SEQ ID NO: 801 - protein, 1003 aa, unidentified
  REGION 1..1003: note = Description of Unknown: uncultivated organism with predicted taxonomy: Collinsella
  REGION 1..1003: note = MG14-127 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 802 - protein, 1003 aa, unidentified
  REGION 1..1003: note = Description of Unknown: uncultivated organism with predicted taxonomy: Collinsella
  REGION 1..1003: note = MG14-128 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALVANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 803 - protein, 1003 aa, unidentified; identical to SEQ ID NO: 799
  REGION 1..1003: note = Description of Unknown: uncultivated organism with predicted taxonomy: Collinsella
  REGION 1..1003: note = MG14-129 effector

SEQ ID NO: 804 - protein, 753 aa, unidentified
  REGION 1..753: note = Description of Unknown: uncultivated organism with predicted taxonomy: Olsenella sp. KH3B4
  REGION 1..753: note = MG14-130 effector
MDVTRSYLVLGLDPGIASCGFCLLDMSNHKILEMGSHLFKAPQEDKTKTSLAVTRRKARSIRRNTARTAARLKHCLELLAGAGLVPADADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGETSAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKK

SEQ ID NO: 805 - protein, 985 aa, unidentified
  REGION 1..985: note = Description of Unknown: uncultivated organism with predicted taxonomy: Collinsella
  REGION 1..985: note = MG14-131 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRMAKPPLEIYFDDLVQIGDFIERFSGYNINSANWSFTDRLTRLNLSCPTVGQLNNDLSPVVIRESPIK

SEQ ID NO: 806 - protein, 1003 aa, unidentified
  REGION 1..1003: note = Description of Unknown: uncultivated organism with predicted taxonomy: Collinsella
  REGION 1..1003: note = MG14-132 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCKLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLINDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 807 - protein, 1004 aa, unidentified
  REGION 1..1004: note = Description of Unknown: uncultivated organism with predicted taxonomy: Collinsella
  REGION 1..1004: note = MG14-133 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 808 - protein, 1003 aa, unidentified; identical to SEQ ID NO: 712
  REGION 1..1003: note = Description of Unknown: uncultivated organism with predicted taxonomy: Collinsella
  REGION 1..1003: note = MG14-135 effector

SEQ ID NO: 809 - protein, 1004 aa, unidentified
  REGION 1..1004: note = Description of Unknown: uncultivated organism with predicted taxonomy: Collinsella
  REGION 1..1004: note = MG14-136 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDCSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 810 - protein, 1024 aa, unidentified
  REGION 1..1024: note = Description of Unknown: uncultivated organism with predicted taxonomy: Clostridiales
  REGION 1..1024: note = MG14-137 effector
MMEYSDPRDFGFRPETVMTALMPYEQFSSKTRRLILGIDMGIASVGVCLIDIRNHEIVLMASHIFKAPVEGKQKDISARQSGASIRRGYRSVRRTTKRRKNRKKAVRDIEKKYILIPDDADGQWFAIRKGEPDVLHLRGKALLYKLNGRELARILYAFAGRRGYIDHGKGATDDDSGKVKKALSVNRKILDENGYETIAQYLLKQPTSRNREGDYRYMVDIEMVTDEVHTIFRHQRDLGSDIATEELEGEYLSALRWLTDTSARDKKIYSRVGYCTYLGAPEKRAASSLISFEMVRAYEKLSNIKIEHQGREATYISPEKRNEIVASLFAVSKNPKPLKWSQLREKLDMQSSDSFDSRLPTDEKDDCIKIPAWNALCTGLFMSNRALLDRFHDDTDAADAVCSALTYASSGGSLRNALENLSLDLSEQDIDSLLDLPYASKLFSGYCSAGVRALQMLRDAFKDPQIEKLYNAEKATGLYEARQALAAARNESRDGLLCPYLEFDPTCTNPVVLRATAQVRRMINSIIRHYGLPDIIRVEVAKDLKRSKREKAIIAATNKANKDSNEQAKKDLVAFYGLPNDAHVSSADFEKMWLYREQFGQDPYTGKGINLERMLNDRDYVEIDHILPFSRSCDDSKSNKVLCLTKSNRDKANRTPYEWMTSGEPSAPDFGDFCRRMDAWAGKGKSAHYTKSKLSKLKNSTFGEEEQKFIDRNLNDTRYMSRQLAMWVRECLPFPDDKRQHVFCVAGAATSLMRRIWGIGIVDEKGKKDRSDDRHHAVDAAVIACCDQRIVKGIARVNSGRSNIKERERLRYESMPYPEFKAQVEAWIPCIVPTRTVSRTATGSLLKDTVYPYVGVDDRGKDLYRRNGKIEPASTLWKDGSGGCKLYDGAYGLMAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLK

SEQ ID NO: 811 - protein, 1003 aa, unidentified
  REGION 1..1003: note = Description of Unknown: uncultivated organism with predicted taxonomy: Collinsella
  REGION 1..1003: note = MG14-138 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKLRGYVPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 812 - protein, 1003 aa, unidentified
  REGION 1..1003: note = Description of Unknown: uncultivated organism with predicted taxonomy: Collinsella
  REGION 1..1003: note = MG14-139 effector
MEITINREIGKLGLPRHLVLGMDPGIASCGFALIDTANHEILDLGVRLFDSPTHPKTGQSLAVIRRGFRSARRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 813 - protein, 1003 aa, unidentified
  REGION 1..1003: note = Description of Unknown: uncultivated organism with predicted taxonomy: Collinsella
  REGION 1..1003: note = MG14-140 effector
MEITINREIGKLELPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 814 - protein, 1000 aa, unidentified; identical to SEQ ID NO: 730
  REGION 1..1000: note = Description of Unknown: uncultivated organism with predicted taxonomy: Olsenella sp. KH3B4
  REGION 1..1000: note = MG14-141 effector

SEQ ID NO: 815 - protein, 1004 aa, unidentified
  REGION 1..1004: note = Description of Unknown: uncultivated organism with predicted taxonomy: Collinsella
  REGION 1..1004: note = MG14-142 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPNLLQRLRDDRDLADAVMEAVAYSSALPVLQERLQGLPLSEAEIEALCMLPYSSKVLNGYGNRSKKALDMLLDCLEEPEVLNLTQGENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARINQETHWSITRGMNETQRHDAIMKALESVMPWETFANEVRAAHDFVVPTRFVPRKGKGELFEQTVYRYAGVNAQGKDLARKVGSDKDIVMGNAVVSADEKSVVKVSEMLCLRLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 816 - protein, 1005 aa, unidentified; identical to SEQ ID NO: 798
  REGION 1..1005: note = Description of Unknown: uncultivated organism with predicted taxonomy: Collinsella
  REGION 1..1005: note = MG14-143 effector

SEQ ID NO: 817 - protein, 1045 aa, unidentified
  REGION 1..1045: note = Description of Unknown: uncultivated organism with predicted taxonomy: Collinsella
  REGION 1..1045: note = MG14-144 effector
MDKAQGVDIGELGFDPGTFATALMTLEEFRSKDRVIWAGIDIGVASTGLCLVDVRNHEIVLMTSHLFKSPVVDKKKATAAPESLASVRRGARSVRRNIMREGRRKKAIRAVLADSDLIPADADGEWFAARRDERTVVKLRSKALGHLLNSRELARVLYSFASHRGYIDHGKSDKDDDAGKVKKALAANHAALAGGGCETFGQYLAGQPRSRNRAGDYSFTSDIGMTVDEVRTIFLRQREMGSEIATEALEERYIAELTWLTDTSKRDMSTYLKVGFCTYRGAPYRRGATSTTSFEMVRAHQTLANTVILHEDGTSSTIPGNTRIEIVRELFAVKKSVKPLKWSGLRRRLGLSDGDSFKGRPLEEEKRDCIALPAWAVLCSGLYEDHRDLLERLHDHIEDADAVCSALTYASSAASLAGRLAPLALTDDEVEAIIDLPYSARLFSGYASASLEALQMLRGTLEDPCVTSLRQAEEDSGLAQARAMLAEEHGEAADGLLCAFSDYDPTCKNPVVLRATAQVRRMVNSVIRHYGLPDVIRVEVARDLKRSKHEREIVAESNRARHELNEQAKRDIVEFLGLHDDDHVRGRDLDMVKLYREQGGKDPYTGTGIDFGRMLEERGYVEIDHILPISRTCDNSQANKVLCLTKSNRDKSNRSPYEWMTSGEATAPDWDEFCGRMERWAKMCEPRRYARKKLANLTCENLAERAGGFIDRNLNDTRYMSVALAKWLRECLPFARDGHEHVFCVAGGATALMRSVWDIGITGPDGKKNRDDDRHHAVDAAVIACCTPGIVKNVALVNEGHARADVRQRLFRDSLPYPEFKEQVNAWIPCIVPTLTLPNTVTGSVLKDTVYPYLGRDDAGKDLYLTVKRDKDGRIVDRKVNKATTMWKDGQGGCRAYGSMCALDAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 818 - protein, 1000 aa, unidentified
  REGION 1..1000: note = Description of Unknown: uncultivated organism with predicted taxonomy: Olsenella sp. KCTC 15699
  REGION 1..1000: note = MG14-145 effector
MDVTRPYLVLGLDPGIASCGFCLLDMTNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNTQGRSRNRGGDYSLCVYNSQIQDEAKALFASQRARGNTKATRELEDSYLACLTWEKKSLDHDARIYELVGPCSYFPGEKRAASADVSSELCRAYERLGHIVIVHEDGSEQALTASQIDGYLKILFSTAPIKGNKECKVSYGTIRKDLDISGKSVFKGVAQDKEKDETFAPKAWRCLRRVLPEELLARMFEDRQLGDAICEALTFASSEASLVERLSDLDLSGDERDAILTVPFTGKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 819 - protein, 1000 aa, unidentified
  REGION 1..1000: note = Description of Unknown: uncultivated organism with predicted taxonomy: Olsenella
  REGION 1..1000: note = MG14-146 effector
MDTTRPYLVLGLDPGIASCGFCLLDMTNHKILEMGSHLFKAPQEDKTKTSLAVTRRKARSIRRNTARTAARLKHCLELLAGAGLVQADADKPWLQTKKGDKPILKLRAGGLDRLLTDREFAQVLYSLCGRRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGTEQALTAGEINDYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLGLSDDERDAILAVPFTGKLFKGYGSRSLKALRLLLGAFEEPEIRILTDAEKATGLLDLRLSDRGVRGQLLPPYDSYDPTCRNPVVLRAMGRMRHIVNAIIRIHGVPDEIHIELGRDLKMSNKEKSLVDKRNRENAASNKKWATTAAGILGCTPEEVPGRIIRKLILREEQGEKDLYTGDSIDLEHLVRDDRYCEIDHILPYSCTCDDSRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFAAEVAARREFVVPTHMANHGVTGRVFEDTLYHLEGITEDKGKYPLVRAGEKTVKKGNVRINPDGSVKLIDGMAFLRLWLDPTARPNGKVKGKWYAEPVYYADIPAIKAGTYVPRACTIHVARVNWEPVPEAAMELEPVVLYAGDVVEINNQLVRYSGFNINGATLYYQSLLNGATTTAIPSLGTWGKDTQVRVLQEDCLGHCYDGILINPEDSTFQKR

SEQ ID NO: 820 - protein, 1002 aa, unidentified; identical to SEQ ID NO: 711
  REGION 1..1002: note = Description of Unknown: uncultivated organism with predicted taxonomy: Olsenella sp. KH3B4
  REGION 1..1002: note = MG14-147 effector

SEQ ID NO: 821 - protein, 828 aa, unidentified
  REGION 1..828: note = Description of Unknown: uncultivated organism with predicted taxonomy: Olsenella mediterranea
  REGION 1..828: note = MG14-148 effector
LIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPIVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIV

SEQ ID NO: 822 - protein, 1003 aa, unidentified
  REGION 1..1003: note = Description of Unknown: uncultivated organism with predicted taxonomy: Collinsella
  REGION 1..1003: note = MG14-149 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDCEWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGISRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVLNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 823 - protein, 863 aa, unidentified
  REGION 1..863: note = Description of Unknown: uncultivated organism with predicted taxonomy: Collinsella
  REGION 1..863: note = MG14-150 effector
MEITINREIGKLGLPRHLVLGMDPGITSCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACNRSLVIKTARINQETHWSITRGMNETQRRDAIMKALESVMPWETFANEVRAAHDFVVPTRFVPRKGKGELFEQTVYRYAGVNAQGKDIARKASSDKDIVMGN

SEQ ID NO: 824 - protein, 1003 aa, unidentified; identical to SEQ ID NO: 822
  REGION 1..1003: note = Description of Unknown: uncultivated organism with predicted taxonomy: Collinsella
  REGION 1..1003: note = MG14-151 effector

SEQ ID NO: 825 - protein, 1005 aa, unidentified; identical to SEQ ID NO: 688
  REGION 1..1005: note = Description of Unknown: uncultivated organism with predicted taxonomy: Collinsella
  REGION 1..1005: note = MG14-152 effector

SEQ ID NO: 826 - protein, 1005 aa, unidentified; identical to SEQ ID NO: 695
  REGION 1..1005: note = Description of Unknown: uncultivated organism with predicted taxonomy: Coriobacteriales
  REGION 1..1005: note = MG14-153 effector

SEQ ID NO: 827 - protein, 1000 aa, unidentified; identical to SEQ ID NO: 733
  REGION 1..1000: note = Description of Unknown: uncultivated organism with predicted taxonomy: Olsenella
  REGION 1..1000: note = MG14-154 effector

SEQ ID NO: 828 - protein, 1000 aa, unidentified; identical to SEQ ID NO: 710
  REGION 1..1000: note = Description of Unknown: uncultivated organism with predicted taxonomy: Olsenella
  REGION 1..1000: note = MG14-155 effector

SEQ ID NO: 829 - protein, 1024 aa, unidentified
  REGION 1..1024: note = Description of Unknown: uncultivated organism with predicted taxonomy: Libanicoccus massiliensis
  REGION 1..1024: note = MG14-156 effector
MDSEQPPYTLGHDRDEWQEIKKHLTNRPYLVLGLDPGISSCGFCLIDFNNHLILEMGSHLFKAPQQDKNNVSLAVVRRNARSTRRNNRRTAARLSHCLALLKEAGLVPNDVDKAWLQTRKGDKPVTKLRAVGLDRPLSDREFAQVLYSLCGKRGYIPHGEGRAGETDDAEGKKVLKAIADNTKAMESGGYRTVGEMLYRSDKGRSRNRGGNYDLCVYNSQIQDEVKVVFSAQRELGNNRATQELEKSYFECLTWEKKSADHDAKVYELVGPCTYFPEEKRAANADVSSELCRAYERLGHLVIVHEDGAEQTLTSEQIDKYIGILFSPSPIRGNKDCKVTYNTIRKDLDISAKSMFKGVAKEKEKDEVFAPKAWRKLRIILPTSLLTSMIEDRSFGDDICEAIAYSSTEETLSERLETIDLSEDDRETLLSVPFTSKLFKGYGNRSRKALDLLIGAFEEPEIRTLTEAEVATGLKGKRDEGRFPRSTLLPPYNAYDETCRNPVVLRAMGRMRRIINSIIKIYGVPDEIHVELARELKQSKREKDLATKRRNAREADNKRYAKLAADILGVEPEAVRGNIIRMLALREEQGCKDIYTGDRIDLERLVTDEHYCEIDHVLPYSRTCDDDQSNKTLTFASNNQNKRERTPYEWMTSDEEKAPNWEEYRNRVIAEVKNPRKRAKFLNTLLDEDTQEGFINRNLNDTRYMSRAVKSYLEDCLIFPKGKREKHVTAVAGGATGNLRWVWGLNFGAHGEKNRKDDRHHAVDAAVIAACNESAVMKVAKTTSMGREQFRKERKARLSNTQPWPTFADEVAAIRELVIPTRMVSHGVTGRMFEDTLYHIDDYTQDRGKYPLVRAKGKQNKGGNIRFISDDTAQKIDGIAFLRLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 830 - protein, 1003 aa, unidentified
  REGION 1..1003: note = Description of Unknown: uncultivated organism with predicted taxonomy: Collinsella
  REGION 1..1003: note = MG14-157 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMDETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 831 - protein, 1005 aa, unidentified; identical to SEQ ID NO: 693
  REGION 1..1005: note = Description of Unknown: uncultivated organism with predicted taxonomy: Collinsella
  REGION 1..1005: note = MG14-158 effector

SEQ ID NO: 832 - protein, 1003 aa, unidentified; identical to SEQ ID NO: 768
  REGION 1..1003: note = Description of Unknown: uncultivated organism with predicted taxonomy: Collinsella
  REGION 1..1003: note = MG14-159 effector

SEQ ID NO: 833 - protein, 1003 aa, unidentified; identical to SEQ ID NO: 732
  REGION 1..1003: note = Description of Unknown: uncultivated organism with predicted taxonomy: Collinsella
  REGION 1..1003: note = MG14-160 effector

SEQ ID NO: 834 - protein, 1003 aa, unidentified; identical to SEQ ID NO: 732
  REGION 1..1003: note = Description of Unknown: uncultivated organism with predicted taxonomy: Collinsella
  REGION 1..1003: note = MG14-161 effector

SEQ ID NO: 835 - protein, 1002 aa, unidentified; identical to SEQ ID NO: 701
  REGION 1..1002: note = Description of Unknown: uncultivated organism with predicted taxonomy: Olsenella
  REGION 1..1002: note = MG14-162 effector

SEQ ID NO: 836 - protein, 1003 aa, unidentified; identical to SEQ ID NO: 732
  REGION 1..1003: note = Description of Unknown: uncultivated organism with predicted taxonomy: Collinsella
  REGION 1..1003: note = MG14-163 effector

SEQ ID NO: 837 - protein, 1000 aa, unidentified; identical to SEQ ID NO: 684
  REGION 1..1000: note = Description of Unknown: uncultivated organism with predicted taxonomy: Olsenella
  REGION 1..1000: note = MG14-164 effector

SEQ ID NO: 838 - protein, 1005 aa, unidentified; identical to SEQ ID NO: 688
  REGION 1..1005: note = Description of Unknown: uncultivated organism with predicted taxonomy: Collinsella
  REGION 1..1005: note = MG14-165 effector

SEQ ID NO: 839 - protein, 1003 aa, unidentified; identical to SEQ ID NO: 755
  REGION 1..1003: note = Description of Unknown: uncultivated organism with predicted taxonomy: Collinsella sp. AM17-1
  REGION 1..1003: note = MG14-166 effector

SEQ ID NO: 840 - protein, 1003 aa, unidentified; identical to SEQ ID NO: 717
  REGION 1..1003: note = Description of Unknown: uncultivated organism with predicted taxonomy: Collinsella
  REGION 1..1003: note = MG14-167 effector

SEQ ID NO: 841 - protein, 1000 aa, unidentified; identical to SEQ ID NO: 694
  REGION 1..1000: note = Description of Unknown: uncultivated organism with predicted taxonomy: Olsenella sp. KH3B4
  REGION 1..1000: note = MG14-168 effector

SEQ ID NO: 842 - protein, 1000 aa, unidentified
  REGION 1..1000: note = Description of Unknown: uncultivated organism with predicted taxonomy: Olsenella
  REGION 1..1000: note = MG14-169 effector
MDVTRPYLVLGLDPGIASCGFCLLDMSNHKILEMGSHLFKAPQEDKTKTSLAVTRRKARSIRRNTARTAARLKHCLELLAGAGLVPANADKTWLQTKKGDKPILKLRAGGLDRLLTDREFAQVLYSLCGRRGYIPHGEGRLGETDEDESRKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHIVIVHEDGSEQALTASEIDDYLKILFSTAPIKGNKECKVSYGTIRKDLDISGKSVFKGIAQDREKDEPFVPKAWRSLRRVLPKGLLARMLEDRKLGDAVCEALTFASSEASLVERLSDLDLSGDKQDAILTVPFTAKLFKGYGSRSLKALGLLLGAFEEPEIRILTDAEKVTGLLDLRLSDRGVRGQLLPPYDSYDPTCRNPVVLRAMGRMRHIVNAIIRIHGVPDEIHIELGRELKMSNKEKSLVDKRNRENAANNKKWAATAAGILGCTPEEVPGRIIRKLILREEQGEKDLYTGEPIDLEHLVRDDRYCEIDHILPYSRTCDDGRANKVLVLSKSNQDKRERTPYEWMTSGEAGAPSWDSYRARVMAQVKNPRKRANYLNTDLGPETQAKFLARNLNDDRYMSVAVKNYLEDCLLFPEDGRKRHVTAVAGGATGNLRWVWGLNFGEGNVKDRADDRHHAIDAAIIAACSESTVKKVAEASAKGREAFKQLRKSRLADTQPWPTFATEVAARREFVVPTRMADHGVTGRVFEDTLYHLEGITDDKGKYPLVRAGEKTAKKGNVHFNPDGSVKLIDGMAFLRLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 843 - protein, 839 aa, unidentified; identical to SEQ ID NO: 708
  REGION 1..839: note = Description of Unknown: uncultivated organism with predicted taxonomy: Olsenella sp. KH3B4
  REGION 1..839: note = MG14-170 effector

SEQ ID NO: 844 - protein, 1001 aa, unidentified; identical to SEQ ID NO: 707
  REGION 1..1001: note = Description of Unknown: uncultivated organism with predicted taxonomy: Coriobacteriia bacterium
  REGION 1..1001: note = MG14-171 effector

SEQ ID NO: 845 - protein, 1003 aa, unidentified; identical to SEQ ID NO: 740
  REGION 1..1003: note = Description of Unknown: uncultivated organism with predicted taxonomy: Collinsella
  REGION 1..1003: note = MG14-172 effector

SEQ ID NO: 846 - protein, 1003 aa, unidentified; identical to SEQ ID NO: 749
  REGION 1..1003: note = Description of Unknown: uncultivated organism with predicted taxonomy: Collinsella
  REGION 1..1003: note = MG14-173 effector

SEQ ID NO: 847 - protein, 856 aa, unidentified
  REGION 1..856: note = Description of Unknown: uncultivated organism with predicted taxonomy: Collinsella
  REGION 1..856: note = MG14-174 effector
EGSQDKSSEGGKVLSALAANKKALAETPCRTVGEWFAQQPQSRNRGGNYDKCVTHAQLIDETHILFEAQRSFGSAFASPEFEAAYIEVCDWERSRKDFDRRSYDLVGRCSYFPAEKRAARCTLTSELVAAYGALGNITIIHEGGTSRALSATERDECIAILFSCEPIRGNKDCAVKFGALRKALDLSSGDYFKGVPAADEKTREVYKPKGWRTLRNTLNAANPILLQRLRDDRDLADAVMEAVAYSSALPVLQEQLQELPLSEAEIEALCKLPYSSKTLNGYGNRSKKALDMLLDCLEEPEVLNLTQAENDCGLLGLRIAGAQLERSDRLMPYETWVELTGRTNNNPVVIRSMSQMRKVVNAICRKWGVPNEIHVELDRELRLPQRAKDEIAKANKKNEKNRERIARQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSIIRGMNETQRRDAIMKALESVMPWETFANEVRVAHDFVVPTRFVPRKGKGELFEQTVYRYAGVNAQGKDIAHKASSDKDIVMGNAVVSADEKSVIKVSEMLCLRLWHDPKAKKGQGAWYADPVYKADIPALKDGTYVPRIAKAHTGRKAWKPVPESATKKPPLEIYLGDLVQIGDFVGRFSGYNIDNANWSFVDRLTRIKTSCPTVGKLSNDMSPFVVRESPIK

SEQ ID NO: 848 - protein, 1003 aa, unidentified; identical to SEQ ID NO: 714
  REGION 1..1003: note = Description of Unknown: uncultivated organism with predicted taxonomy: Collinsella
  REGION 1..1003: note = MG14-175 effector

SEQ ID NO: 849 - protein, 1003 aa, unidentified; identical to SEQ ID NO: 714
  REGION 1..1003: note = Description of Unknown: uncultivated organism with predicted taxonomy: Collinsella aerofaciens
  REGION 1..1003: note = MG14-176 effector

SEQ ID NO: 850 - protein, 1003 aa, unidentified; identical to SEQ ID NO: 734
  REGION 1..1003: note = Description of Unknown: uncultivated organism with predicted taxonomy: Collinsella
  REGION 1..1003: note = MG14-177 effector

SEQ ID NO: 851 - protein, 1000 aa, unidentified
  REGION 1..1000: note = Description of Unknown: uncultivated organism with predicted taxonomy: Olsenella sp. GAM18
  REGION 1..1000: note = MG14-178 effector
MDATRPYLVLGLDPGIASCGFCLLDMTNHKILEMGSHLFKAPQEDKTKTSLAVTRRKARSIRRNTARTSARLKHCLELLAGAGLVPADADKTWLQTKKGDKPILKLRAGGLDRLLTDREFAQVLYSLCGHRGYIPHGEGRLGETDEDESKKVLGAIKKNQDAMAAGSYRTVGEMLNAQGRSRNRGGDYSLCVYNSQIQDEAKALFASQRARGNTKATRELEDSYLACLTWEKKSLDHDTRVYELVGPCSYFPGEKRAASADVSSELCRAYERLGHTVIVHEDGSEQALTAGEIDGYLKILFSTAPIKGNKECKVTYGTIRKDLDISGKSVFKGIAQDKEKDEPFAPKAWRSLRRVLPERLLARMLEDRNLGDAVCEALTFASSEASLIERLSDLDLSDDERDAILTVPFTGKLFKGYGSRSLKALGLLLGAFEEPEIRILTDAEKVTGLLDLRLSDRDVRGQLLPPYSSYDPTCRNPVVLRAMGRMRHIVNAIFRIHGIPDEIHIELGRDLKMSNKEKILVDKRNRENAASNKKWATTAAGILGCTPEEVPGRIIRKLILREEQGEKDLYTGDSIDLEHLVRDDRYCEIDHILPYSRTCDDSRANKVLVLSKSNQDKRERTPYEWMTSGEAGAPSWDSYRARVIAQVKNPRKRANYLNTDLGPETQAKFLARNLNDDRYMSVAVKNYLEDCLLFPEDGRKRHVTAVAGGATGNLRWVWGLNFGEGNIKDRTDDRHHAVDAAIIAACSESTVKKVAEASAKGREAFKQLRKSRLADTQPWPTFATEVAARREFVVPTRMADHGVTGRVFEDTLYHLEGIAEGKGKYPLVRASEKTVKKGNVRINPDGSVKLIDGMAFLRLWLDPTARPNGKVKGKWYAEPVYYADIPAIKAGTYVPRACTIHVARVNWEPVPEAAMGANPVIVFFGDVLSVDNHVGRFGGFDIFGGRLALLNLLTKQEVSDWPSLGSWGKDTQVRVLQEDCLGHCYDSIAINPEGSTFQQR

SEQ ID NO: 852 - protein, 1003 aa, unidentified; identical to SEQ ID NO: 718
  REGION 1..1003: note = Description of Unknown: uncultivated organism with predicted taxonomy: Collinsella
  REGION 1..1003: note = MG14-179 effector

SEQ ID NO: 853 - protein, 1003 aa, unidentified; identical to SEQ ID NO: 791
  REGION 1..1003: note = Description of Unknown: uncultivated organism with predicted taxonomy: Collinsella
  REGION 1..1003: note = MG14-180 effector

SEQ ID NO: 854 - protein, 1000 aa, unidentified; identical to SEQ ID NO: 745
  REGION 1..1000: note = Description of Unknown: uncultivated organism with predicted taxonomy: Olsenella
  REGION 1..1000: note = MG14-181 effector

SEQ ID NO: 855 - protein, 1003 aa, unidentified; identical to SEQ ID NO: 797
  REGION 1..1003: note = Description of Unknown: uncultivated organism with predicted taxonomy: Olsenella mediterranea
  REGION 1..1003: note = MG14-182 effector

SEQ ID NO: 856 - protein, 1002 aa, unidentified; identical to SEQ ID NO: 788
  REGION 1..1002: note = Description of Unknown: uncultivated organism with predicted taxonomy: Collinsella
  REGION 1..1002: note = MG14-183 effector

SEQ ID NO: 857 - protein, 1002 aa, unidentified; identical to SEQ ID NO: 796
  REGION 1..1002: note = Description of Unknown: uncultivated organism with predicted taxonomy: Olsenella
  REGION 1..1002: note = MG14-184 effector

SEQ ID NO: 858 - protein, 1003 aa, unidentified; identical to SEQ ID NO: 752
  REGION 1..1003: note = Description of Unknown: uncultivated organism with predicted taxonomy: Collinsella
  REGION 1..1003: note = MG14-185 effector

SEQ ID NO: 859 - protein, 1002 aa, unidentified; identical to SEQ ID NO: 770
  REGION 1..1002: note = Description of Unknown: uncultivated organism with predicted taxonomy: Collinsella
  REGION 1..1002: note = MG14-186 effector

SEQ ID NO: 860 - protein, 1003 aa, unidentified; identical to SEQ ID NO: 764
  REGION 1..1003: note = Description of Unknown: uncultivated organism with predicted taxonomy: Coriobacteriales
  REGION 1..1003: note = MG14-187 effector

SEQ ID NO: 861 - protein, 1003 aa, unidentified; identical to SEQ ID NO: 806
  REGION 1..1003: note = Description of Unknown: uncultivated organism with predicted taxonomy: Collinsella
  REGION 1..1003: note = MG14-188 effector

SEQ ID NO: 862 - protein, 1003 aa, unidentified; identical to SEQ ID NO: 717
  REGION 1..1003: note = Description of Unknown: uncultivated organism with predicted taxonomy: Collinsella
  REGION 1..1003: note = MG14-189 effector

SEQ ID NO: 863 - protein, 1003 aa, unidentified
  REGION 1..1003: note = Description of Unknown: uncultivated organism with predicted taxonomy: Collinsella
  REGION 1..1003: note = MG14-190 effector
MEITINREIGKLGLPRHLVLGMDPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGSQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 864 - protein, 1003 aa, unidentified; identical to SEQ ID NO: 802
  REGION 1..1003: note = Description of Unknown: uncultivated organism with predicted taxonomy: Collinsella
  REGION 1..1003: note = MG14-191 effector

SEQ ID NO: 865 - protein, 1003 aa, unidentified; identical to SEQ ID NO: 760
  REGION 1..1003: note = Description of Unknown: uncultivated organism with predicted taxonomy: Collinsella
  REGION 1..1003: note = MG14-192 effector

SEQ ID NO: 866 - protein, 1003 aa, unidentified; identical to SEQ ID NO: 777
  REGION 1..1003: note = Description of Unknown: uncultivated organism with predicted taxonomy: Collinsella
  REGION 1..1003: note = MG14-193 effector

SEQ ID NO: 867 - protein, 1004 aa, unidentified; identical to SEQ ID NO: 729
  REGION 1..1004: note = Description of Unknown: uncultivated organism with predicted taxonomy: Olsenella
  REGION 1..1004: note = MG14-194 effector

SEQ ID NO: 868 - protein, 1003 aa, unidentified; identical to SEQ ID NO: 714
  REGION 1..1003: note = Description of Unknown: uncultivated organism with predicted taxonomy: Collinsella
  REGION 1..1003: note = MG14-195 effector

SEQ ID NO: 869 - protein, 1046 aa, unidentified; identical to SEQ ID NO: 739
  REGION 1..1046: note = Description of Unknown: uncultivated organism with predicted taxonomy: Collinsella
  REGION 1..1046: note = MG14-196 effector

SEQ ID NO: 870 - protein, 1003 aa, unidentified; identical to SEQ ID NO: 801
  REGION 1..1003: note = Description of Unknown: uncultivated organism with predicted taxonomy: Collinsella
  REGION 1..1003: note = MG14-197 effector

SEQ ID NO: 871 - protein, 1003 aa, unidentified
  REGION 1..1003: note = Description of Unknown: uncultivated organism with predicted taxonomy: Collinsella
  REGION 1..1003: note = MG14-198 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNATNPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHRSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPALKDGTYVPRIAKAHTGRKAWKPVPGSAMKKPPLEIYPGDLVQIGDFVGRFSGYNIDNANWSFVDRLTRIKISCPTVGKLSNDMSPFVVRESPIK

SEQ ID NO: 872 - protein, 862 aa, unidentified; identical to SEQ ID NO: 747
  REGION 1..862: note = Description of Unknown: uncultivated organism with predicted taxonomy: Collinsella
  REGION 1..862: note = MG14-199 effector

SEQ ID NO: 873 - protein, 833 aa, unidentified; identical to SEQ ID NO: 721
  REGION 1..833: note = Description of Unknown: uncultivated organism with predicted taxonomy: Collinsella
  REGION 1..833: note = MG14-200 effector

SEQ ID NO: 874 - protein, 1003 aa, unidentified; identical to SEQ ID NO: 813
  REGION 1..1003: note = Description of Unknown: uncultivated organism with predicted taxonomy: Collinsella
  REGION 1..1003: note = MG14-201 effector

SEQ ID NO: 875 - protein, 1003 aa, unidentified; identical to SEQ ID NO: 799
  REGION 1..1003: note = Description of Unknown: uncultivated organism with predicted taxonomy: Collinsella
  REGION 1..1003: note = MG14-202 effector

SEQ ID NO: 876 - protein, 1003 aa, unidentified; identical to SEQ ID NO: 799
  REGION 1..1003: note = Description of Unknown: uncultivated organism with predicted taxonomy: Collinsella
  REGION 1..1003: note = MG14-203 effector

SEQ ID NO: 877 - protein, 1003 aa, unidentified
  REGION 1..1003: note = Description of Unknown: uncultivated organism with predicted taxonomy: Collinsella
  REGION 1..1003: note = MG14-204 effector
MEITINREIGKLGLPRHLVLGMDPGIASCGFALIDTANHEILDLGVRLFDSPTHPKTGQSLAVIRRGFRSTRRNIDRTQARLKHCLQVFKAHGLIPQDATKEYFHTTKGDKQPLKLRVDGLDRLLSDREWALVLYSLCKRRGYIPHGEGNQDKSSEGGKVLSALAANKEAIAEASCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQERLQGLPLSEAEIEALCRLPYSSKALNGYGNRSKKALDMLLDCLEEPEVFNLTQAENDCGLLGLRIAGAQLERSDRLMPYELWAERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDAKEGDFLARSFTDTAYMSREVCAYLADCLQFPDDGAKAHVVPTTGRATAWLRRRWGLNFGSNGEKDRSDDRHHATDACVIAACSRSLVIKTARLNQETHWSITRGMNEIQRHDAIMKALESVMPWETFANEVRAAHDFVVPTRFVPRKGKGELFEQTVYRYAGVNAQGKDLARKAGSDKDIVMGNAVVSADEKSVIKVSEMLCLRLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPIVGQLNNDLSPVVIRESPIK

SEQ ID NO: 878 - protein, 958 aa, unidentified
  REGION 1..958: note = Description of Unknown: uncultivated organism with predicted taxonomy: Olsenella mediterranea
  REGION 1..958: note = MG14-205 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTNELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDTFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQSVLNSAPLEIYLGDLVQIGNQKGR

SEQ ID NO: 879 - protein, 762 aa, unidentified
  REGION 1..762: note = Description of Unknown: uncultivated organism with predicted taxonomy: Collinsella
  REGION 1..762: note = MG14-206 effector
MEITINREIGKLGLPRHLVLGMDPGIASCGFALIDTANHEILDLGVRLFDSPTHPKTGQSLAVIRRGFRSTRRNNDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHACHRCLCDCSM

SEQ ID NO: 880 - protein, 1004 aa, unidentified; identical to SEQ ID NO: 809
  REGION 1..1004: note = Description of Unknown: uncultivated organism with predicted taxonomy: Collinsella
  REGION 1..1004: note = MG14-207 effector

SEQ ID NO: 881 - protein, 1000 aa, unidentified; identical to SEQ ID NO: 776
  REGION 1..1000: note = Description of Unknown: uncultivated organism with predicted taxonomy: Olsenella
  REGION 1..1000: note = MG14-208 effector

SEQ ID NO: 882 - protein, 1003 aa, unidentified; identical to SEQ ID NO: 738
  REGION 1..1003: note = Description of Unknown: uncultivated organism with predicted taxonomy: Collinsella
  REGION 1..1003: note = MG14-209 effector

SEQ ID NO: 883 - protein, 1004 aa, unidentified; identical to SEQ ID NO: 754
  REGION 1..1004: note = Description of Unknown: uncultivated organism with predicted taxonomy: Collinsella
  REGION 1..1004: note = MG14-210 effector

SEQ ID NO: 884 - protein, 1002 aa, unidentified; identical to SEQ ID NO: 715
  REGION 1..1002: note = Description of Unknown: uncultivated organism with predicted taxonomy: Collinsella
  REGION 1..1002: note = MG14-211 effector

SEQ ID NO: 885 - protein, 1046 aa, unidentified; identical to SEQ ID NO: 769
  REGION 1..1046: note = Description of Unknown: uncultivated organism with predicted taxonomy: Collinsella
  REGION 1..1046: note = MG14-212 effector

SEQ ID NO: 886 - protein, 1002 aa, unidentified; identical to SEQ ID NO: 771
  REGION 1..1002: note = Description of Unknown: uncultivated organism with predicted taxonomy: Collinsella
  REGION 1..1002: note = MG14-213 effector

SEQ ID NO: 887 - protein, 1002 aa, unidentified; identical to SEQ ID NO: 771
  REGION 1..1002: note = Description of Unknown: uncultivated organism with predicted taxonomy: Coriobacteriales
  REGION 1..1002: note = MG14-214 effector

SEQ ID NO: 888 - protein, 798 aa, unidentified
  REGION 1..798: note = Description of Unknown: uncultivated organism with predicted taxonomy: Olsenella
  REGION 1..798: note = MG14-215 effector
MELVKPYYVLGLDLGPASCGFALIDINNMRILEIGSHLFDAPQENKKQTKVSLAAKRRSARSARRNNQRTKNRQKHCIKLLREAKLIPQDASGVWFQTKKGDRPSLKLRDRGLEERLSDREFAQILYTLSARRGYIPHGEGKLGYSKESSDSDLGKVLKAVSENSNALSNGKSRTVGELLYERGSSRNTAGAYDHCVLNSQIVEEVHALFKAQRDFGNDKASEQLENDYIANLTWEKKTLDIDAASYARVGFCTYFEEEKRAARADYSSELCAAYERLGHLTIVDSDGTETRLDPSRRNRYLSILFSPKALPKNKYCKVRYSDIRRDLDLSSDSAFKGVEADQEKDKEPFEPKAWRCMRENGISENLLERMLSDRDFADAIGEALTYASTKDSLLNQLDTVDLTSAEKESIAGLPFSSKIFKGYGNRSLKALYMLLDAFEDPDILTLADAETATGLKGKRLADNYQRSAFLPLYEIYDNDCNNPVVLRAMSRMRRIVNAIIKIYGVPDEIHIELARELKQSKREKDAISKFQRKKEQANNRYREVAAGILNISPDEVSDRIIEKMAFREQQNDKDAYTGTTINLERLVTDSHYCQVDHVLPYSRTSDNSRNNRVLVLSTTNQNKRERTPFEWMNSGEANAPAWNDYKKHVLANKNYSQRKKQVYLLNENLDSETEAQFISRNLNDTRYMSRATMAFLADTLEYPDDGRKRHVIAVAGSATSALRHVWGLNFGEGNVKDRSDDRHHAVDACVIAACSESTLKKVARARSRGYRSFKKTQESRLSDTQPWPTFADDVIAM

SEQ ID NO: 889 - protein, 1005 aa, unidentified; identical to SEQ ID NO: 744
  REGION 1..1005: note = Description of Unknown: uncultivated organism with predicted taxonomy: Collinsella
  REGION 1..1005: note = MG14-216 effector

SEQ ID NO: 890 - protein, 1004 aa, unidentified; identical to SEQ ID NO: 737
  REGION 1..1004: note = Description of Unknown: uncultivated organism with predicted taxonomy: Collinsella
  REGION 1..1004: note = MG14-217 effector

SEQ ID NO: 891 - protein, 769 aa, unidentified
  REGION 1..769: note = Description of Unknown: uncultivated organism with predicted taxonomy: Olsenella mediterranea
  REGION 1..769: note = MG14-218 effector
AAFGALPPKASARRTYDLVGHCSYFPTEKRAARCTLTSELVSAYGALGNITIIHENGTSRALSATERDECIAILFSCEPIRDNKDCAVKFGALRKALDLSSGDYFKGVPAADEKTREVYKPKGWRVLRNTLNATNPILLQRLRDDRDLADAVMEAVAYSSALPVLQEQLQGLPLSEAEIEALCRLPYSSKALNGYGNRSKKALDVLLDCLEEPEVLNLTQAENDCGLLGLRIAGAQLERSDRLMPYETWIERTGRTNNNPVVIRAMSQMRKVVNAICRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLSFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDLARKASSDKNIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 892 - protein, 1003 aa, unidentified; identical to SEQ ID NO: 767
  REGION 1..1003: note = Description of Unknown: uncultivated organism with predicted taxonomy: Collinsella
  REGION 1..1003: note = MG14-219 effector

SEQ ID NO: 893 - protein, 985 aa, unidentified; identical to SEQ ID NO: 805
  REGION 1..985: note = Description of Unknown: uncultivated organism with predicted taxonomy: Collinsella
  REGION 1..985: note = MG14-220 effector

SEQ ID NO: 894 - protein, 1003 aa, unidentified; identical to SEQ ID NO: 789
  REGION 1..1003: note = Description of Unknown: uncultivated organism with predicted taxonomy: Collinsella
  REGION 1..1003: note = MG14-221 effector

SEQ ID NO: 895 - protein, 1003 aa, unidentified; identical to SEQ ID NO: 778
  REGION 1..1003: note = Description of Unknown: uncultivated organism with predicted taxonomy: Collinsella
  REGION 1..1003: note = MG14-222 effector

SEQ ID NO: 896 - protein, 1053 aa, unidentified
  REGION 1..1053: note = Description of Unknown: uncultivated organism with predicted taxonomy: Collinsella sp. AM13-34
  REGION 1..1053: note = MG14-223 effector
VIRLESGMDKAKGADIGELGFDPATFATALMTLEEFRSKDRVIWAGLDIGVASTGLCLVDVRNHEIVLMASHLFKSPVVDKKKATAAPESLASVRRGARSVRRNIMREGRRKKAIRAALADFDLIPADADGEWFSARRDERTVVRLRSKALGYLLNSRELARVLYSFASHRGYIDHGKSDKEDDAGKVKKALAANHAALADGGCKTFGQYLAGQPRSRNRAGDYSYTADIGMTVDEVRTIFARQRELGSEIASKALEERYIAELTWLTDTSKRDRSTYLKVGFCTYLGAPYRRGATSTISFEMVRAHQTLCNTVILHADGTSSTIPGDIRIEIVRDLFAVKKSVKPLKWSGLRRRLGLSEGDSFKGRPVEEEKRDCIALPAWAVLCAGLYEGHRDLLERLHDHIDDADAVCSALTFASSAASLAGRLAPLALSDDEVEAIIDLPYSARLFSGYANASLEALQMLRGTFEDPRVTSLRQAEEDSGLAQARAILAEERGGSADGLLCAFSDYDPTCRNPVVLRATAQVRRMVNSVIRHYGLPDVIRVEVARDLKRSKHEREIVAESNRARLELNEQAKRDIIEFLGLPDDHHVRGRDLALVKLYREQGGKDPYTGAAIDFRRMLEEHRYAEIDHILPVSRTCDDSQANKVLCLTKSNRDKSNRSPYEWMTSGEASAPDWGEFCGRMERWAKMCEPRRYARKKLANLTCENLAERAGNFIDRNLNDTRYMSVALAKWLRECLPFTKDGHEHVFCVAGGATALMRSVWDIGITGPDGKKNRDDDRHHAVDAAVIACCTPGIVRNVALVNEGHARADVRQRLFSDSLPYPEFKEQVDAWIPCIVPTLTLPNTVTGSVLKDTVYPYLGRDEAGKDLYLTVKRDKDGRIVERKVNKATTMWKDGQGGCRAYGSMCALEAVFDASAGKRGRWSFDPVYCIDIPHREAVRRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAAGVQME

SEQ ID NO: 897 - protein, 1004 aa, unidentified; identical to SEQ ID NO: 742
  REGION 1..1004: note = Description of Unknown: uncultivated organism with predicted taxonomy: Collinsella
  REGION 1..1004: note = MG14-224 effector

SEQ ID NO: 898 - protein, 1003 aa, unidentified
  REGION 1..1003: note = Description of Unknown: uncultivated organism with predicted taxonomy: Collinsella
  REGION 1..1003: note = MG14-225 effector
MEITINREIGKLGLPRHLVLGMDPGIASCGFALIDTANHEILDLGVRLFDSPIHPKTKQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGKWLAQQPQSRNRGGNYDKCVTHAQLIEETHILFDAQRSFGSKYASPEFEAAYIEVCDWERSRKDFDRRTYDIVGHCSYFPTEKRAARCTLTSELVSAYGALGNITIIHENGTSRALTATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 899 - protein, 1003 aa, unidentified; identical to SEQ ID NO: 898
  REGION 1..1003: note = Description of Unknown: uncultivated organism with predicted taxonomy: Collinsella
  REGION 1..1003: note = MG14-226 effector

SEQ ID NO: 900 - protein, 1005 aa, unidentified; identical to SEQ ID NO: 727
  REGION 1..1005: note = Description of Unknown: uncultivated organism with predicted taxonomy: Collinsella
  REGION 1..1005: note = MG14-227 effector

SEQ ID NO: 901 - protein, 1026 aa, unidentified; identical to SEQ ID NO: 794
  REGION 1..1026: note = Description of Unknown: uncultivated organism with predicted taxonomy: Olsenella
  REGION 1..1026: note = MG14-228 effector

SEQ ID NO: 902 - protein, 1005 aa, unidentified
  REGION 1..1005: note = Description of Unknown: uncultivated organism with predicted taxonomy: Olsenella
  REGION 1..1005: note = MG14-229 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRQLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDHRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCTYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 903 - protein, 1004 aa, unidentified; identical to SEQ ID NO: 774
  REGION 1..1004: note = Description of Unknown: uncultivated organism with predicted taxonomy: Collinsella
  REGION 1..1004: note = MG14-230 effector

SEQ ID NO: 904 - protein, 1004 aa, unidentified; identical to SEQ ID NO: 786
  REGION 1..1004: note = Description of Unknown: uncultivated organism with predicted taxonomy: Collinsella
  REGION 1..1004: note = MG14-231 effector

SEQ ID NO: 905 - protein, 1003 aa, unidentified; identical to SEQ ID NO: 812
  REGION 1..1003: note = Description of Unknown: uncultivated organism with predicted taxonomy: Collinsella
  REGION 1..1003: note = MG14-232 effector

SEQ ID NO: 906 - protein, 1003 aa, unidentified; identical to SEQ ID NO: 734
  REGION 1..1003: note = Description of Unknown: uncultivated organism with predicted taxonomy: Collinsella
  REGION 1..1003: note = MG14-233 effector

SEQ ID NO: 907 - protein, 1004 aa, unidentified; identical to SEQ ID NO: 815
  REGION 1..1004: note = Description of Unknown: uncultivated organism with predicted taxonomy: Collinsella
  REGION 1..1004: note = MG14-234 effector

SEQ ID NO: 908 - protein, 1002 aa, unidentified; identical to SEQ ID NO: 790
  REGION 1..1002: note = Description of Unknown: uncultivated organism with predicted taxonomy: Collinsella
  REGION 1..1002: note = MG14-235 effector

SEQ ID NO: 909 - protein, 1004 aa, unidentified; identical to SEQ ID NO: 807
  REGION 1..1004: note = Description of Unknown: uncultivated organism with predicted taxonomy: Collinsella
  REGION 1..1004: note = MG14-236 effector

SEQ ID NO: 910 - protein, 1002 aa, unidentified
  REGION 1..1002: note = Description of Unknown: uncultivated organism with predicted taxonomy: Collinsella
  REGION 1..1002: note = MG14-237 effector
MEITINREIGKLGLPRHLVLGMDPGIASCGFALIDTANHEILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPELEAAYIEVCDWERSRKDFDRRTYDLVGHCSYFPTEKRAARCTLTSELVSAYGALGNITIIHENGTSRALSATERDECIAILFSCEPIRDNEDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAVCRKWGVPNEIHVELDRELRLPQRAKDEIAKANKKNEKNRERIAGQIAELRGCTADEVTGKQIEKYRLWEEQECFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSRSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 911 - protein, 1027 aa, unidentified; identical to SEQ ID NO: 782
  REGION 1..1027: note = Description of Unknown: uncultivated organism with predicted taxonomy: Atopobium sp. ICM42b
  REGION 1..1027: note = MG14-238 effector

SEQ ID NO: 912 - protein, 1004 aa, unidentified
  REGION 1..1004: note = Description of Unknown: uncultivated organism with predicted taxonomy: Collinsella
  REGION 1..1004: note = MG14-239 effector
MEITINREIGKLGLPRHLVLGMDPGIASCGFALIDTANREILDLGVRLFDSPTHPKTGQSLAVIRRGFRSTRRNIDRTQARLKHCLQILKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKCVTHAQLIEETHILFDAQRSFGSKYASPEFEAAYIEVCDWERSRKDFDRRTYDLVGHCSYFPTEKRAARCTLTSELVSAYGALGNITIIHDDGTSRALSATERDECIAILFSCEPIRGNKDCAVKFGALRKALDLSSGDYFKGVPAADEKTREVYKPKGWRVLRNTLNAANPILLQRLRDDRNLADAVMEAVAYSSALPVLQEQLQGLPLSEAEIEALCRLPYSSKALNGYGNRSKKALDMLLDCLEEPEVLNLTQAENDCGLLGLRIAGTQLERSDRLMPYETWIELTGRTNNNPVVIRSMSQMRKVVNAVCRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFVRRVQENQKLSRRKKNFLLEKDLDTKEGEFLARSFTDTAYMSREVCAYLADCLLFPDDGAKAHVVPTTGRATAWLRRRWGLNFGSNREKDRSDDRHHATDACVIAACSRSLVIKTARINQETHWSITRGMNETQRRNAIMKALESVMPWETFANEVRAAHDFVVPTRFVPRKGKGELFEQTVYRYAGVNAQGKDLARKASSDKDIVMGNAVVSADEKSVIKVSEMLCLRLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 913 - protein, 1003 aa, unidentified; identical to SEQ ID NO: 772
  REGION 1..1003: note = Description of Unknown: uncultivated organism with predicted taxonomy: Collinsella
  REGION 1..1003: note = MG14-240 effector

SEQ ID NO: 914 - protein, 1004 aa, unidentified; identical to SEQ ID NO: 795
  REGION 1..1004: note = Description of Unknown: uncultivated organism with predicted taxonomy: Collinsella
  REGION 1..1004: note = MG14-241 effector

SEQ ID NO: 915 - protein, 1003 aa, unidentified; identical to SEQ ID NO: 753
  REGION 1..1003: note = Description of Unknown: uncultivated organism with predicted taxonomy: Collinsella
  REGION 1..1003: note = MG14-242 effector

SEQ ID NO: 916 - protein, 1004 aa, unidentified; identical to SEQ ID NO: 766
  REGION 1..1004: note = Description of Unknown: uncultivated organism with predicted taxonomy: Collinsella
  REGION 1..1004: note = MG14-243 effector

SEQ ID NO: 917 - protein, 1006 aa, unidentified
  REGION 1..1006: note = Description of Unknown: uncultivated organism
  REGION 1..1006: note = MG14-244 effector
MAMRRPYLVLGLDPGIASCGFCLLDLTNHKILLMGVRLFSVPKNRSGVSLAAERRAARSTRRNNHRTKSRLKRCLSILKAAGLVPEDADRGWLQARKKDKPVIKLRAVGLVRILSDRELAQALYSLCEHRGYIPHGEGKEGAADDADGKKVLSAIKKNMEDMDKGGYRTVGEMLYTQGRSRNRGGNYDRCVYNSQIQEEVSSIFAAQRSFGNPKATAELEQEYMECLTSEKSSSGHDRRSYEAVGSCVYFPELKRAAKADISSELCRAYERFGHLVIVHKDGTEQTLTSEQISRYISALFTPSAIQKKVQRITCATIRKDLDISGASVFKGVSHEQEKKEVFDPKAWRCLSKCLAGDHGELLERMWQDRSLGDAVCEALTYSSTEESLEGQLETLDLSEDECRALKAVPFNSKIFKGYGTRSIKALSLLVGAFEDPDVRTLADAEKATGLDMKRAEDRMPRSTKLPPYSVYDPTCKNPVVLRAMGQMRKIVNAIIKEHGVPDEIHIELSRDLKMSKREKDAVAKRQRTNEAANKKRATLAAGILGCEPSEVSHLVIRKLALREEQSDKDIYTGAAIDLQRLVEDDHYCEIGHILPYSRTGMGGWNNEVLVLAASNQKKRERTPYEWMQQDAGKAGVPAWDEYSSRVTATIDNPRKRRNLLCKDTGDEAMNGFLLRDLNDTRYMSVAVKNYLEDCLLFPEDGRKLHVTAVSGGATASLRRVWGLNSNGSDDEKTNSNTMRNSIDAAVIAACSVKTVQAVAKTRSLGRETFRHMRRSRLADTQPWETFADDVIVKCKTVIPTRMAEHGVTGCALNEFVYRIDGFNEKGYAILSRQVDRATRKRGIQVAGNYMPFGESSAKLVGQIAFIRLWHDPDFGKDGRWYVEPVYYNDIPALGNGVYQPKYILSKHPRMEWLPVPEAALSGTPLTLFPGDIIVAGNHIARFKKLDIACQGLGMLNILNEQLAVKNFPTINRWKNDMNIFILQEDCLGKCFNSLDIDSGSSTFTLR

SEQ ID NO: 918 - protein, 1006 aa, unidentified
  REGION 1..1006: note = Description of Unknown: uncultivated organism with predicted taxonomy: Olsenella
  REGION 1..1006: note = MG14-245 effector
MEANRPYLVLGLDPGIASCGFCLLDMTDHKILEMGSHLFDAPQEAKTKTSLAVTRRNARSARRNTLRTATRMKHCLALLKGADLVPEDADKAWLQSKKGDKPILKLRANGLDRKLADREFAQVLYSLCGRRGYIPHGEGRLGETDDGEGRKVLSAIKANEATMKRGNYRTVGEMLYANDGKSRNRGGDYSLCVYNSQIKDEVRALFAAQRALGNSKASEGFEKDYIDCLEWEKKTVDHDKRVYELVGACPYFPEEKRAADADISSELCRAYERLGHIAIVHEDGSEQNLTPNQIDGYLDVLFSPLPLKGNKECKVTYGTIRKDLDLSGKDVFKGVAQDGEKGEPFSPKSWRCLRTALYENHEDLLVRMLKDRELGDDICEALTFASTEASLGERLGLLDLTDDEQAALCSSVPFTGKLFKGYGNRSLKALGILLGAFEEPEIRTLTDAERATGLLDLRLADRGLRDNLLPSYSKYDPTCRNPVVLRSMGRMRRIVNAIIRIHGVPDEIHIELGRDLKMSNKEKATVSKNQRANEAANKKWAAKAANILGCSPEEVPGRIVRKLAMREEQGDKDAYTGAAIDLEHLVRDDRYCEIDHILPYSRTCDDSRANKVLVLSKSNQDKRERTPYEWMTSGEPGAPDWDEYRNRVMATVKYARKRANLLNTDLGPNVQAQFLARNLNDDRYMSVAVKNYLEDCLLFPNDGRKKHVTAVAGGATGNLRWVWGLNFGQGNTKDRDDDRHHAVDAAIIAACSESTVKKVAEASSKGRETFKHLRKSRLSDTQPWPTFAEEVAARRAFVVPTRMVNHGVTGRVFEDTLYHLEGFTNDKGKYPLVRAGEKTAKKGNVRIGPDGSVKLIDGMAFLRLWLDPNARPNGKVKGKWYAEPVYYADIPAIKAGTYVPRACTIHVARNAWEPVPESAMQREPVVLFAGDVVEVDGHIGRYSGFNIFGGRITILNLLTKAEVGDWPSLGSWGRDTQVRVLQEDCLGHCYDDIVINPDNSTFRQRE

SEQ ID NO: 919 - protein, 1027 aa, unidentified
  REGION 1..1027: note = Description of Unknown: uncultivated organism with predicted taxonomy: Coriobacteriales
  REGION 1..1027: note = MG14-246 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLLPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 920 - protein, 1027 aa, unidentified
  REGION 1..1027: note = Description of Unknown: uncultivated organism with predicted taxonomy: Coriobacteriales
  REGION 1..1027: note = MG14-247 effector
MGQQNQEMANARHYLVLGLDPGIASCGFCLLDMTDHKILEMGSHLFDAPQNPKSKQNLSVERRNARSARRNLKRTRDRQKKCLELLKQCGLSPSDADKQWLQSRKGDKPVIKLRASALDRTLTDRELAQVLYSLTGRRGYIPHGEGHLDDVDDAEAGKVLAAVRENQNQMAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 921 - protein, 858 aa, unidentified
  REGION 1..858: note = Description of Unknown: uncultivated organism
  REGION 1..858: note = MG14-248 effector
MAKKGYRTVGQMLYKEGRSRNRGGDYTLCVLNSQIIDEAKIILDEQRSHGNAILTKMSNGEFEQFTNSYIDCLTWEKKSTKHDERVYSLVGACTYFPEEKRAAEADLSSELCRAYERFGHLVMVDADGTEHRLSAKDRARYLQILFSPVPIRGNKDCKVTYATIRKDLDLSAHVSFKGIEAERENKEEPFSPRRWRKLRACGVPEGLLARMLEDRDLADSIGEALAYASTEESLRDKLSSLDLSDDEINQLAVNVPFAGKLFSGYGSRSLKALHMLLDMFEDESILTLDDAERESGLQALRLADKGHRSLNLPPYDIYDPTCNNPTVLRALGRMRRIVNAIIRIYGVPDEIHIELGKELKQSSKEKKSIAKSNLQNKKDNERIAKTIAELLGCSPDDVRGKQIRRFALREEQGCKDAYTGDSIDLMRMLTEDRYTEIDHILPYSRTCDDSRANKVLVLQKSNQDKKERTPWEWMSDDASKGAPDWEEFKARTLTNHRLSYKKRDHLLNQNLNGQEQSFIDRNLNDTRYMSVAVKDYLEKSLLFPDDGRKSHVIAVAGGATSALRHVWGLNFGADNTKDRSDDRHHAVDAAVIAACSQATVKKVADTSKLGHSEFKRKRESRLADTQPWPTFADEVIARREFVIPTRMANHGVTGSAFEDTIYRYEGIREGKDSLAVLSKSQGKDKPRAVKPSGNYRLDADGGAHLYDGIAFLRFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 922 - protein, 1027 aa, unidentified; identical to SEQ ID NO: 920
  REGION 1..1027: note = Description of Unknown: uncultivated organism with predicted taxonomy: Olsenella
  REGION 1..1027: note = MG14-249 effector

SEQ ID NO: 923 - protein, 1007 aa, unidentified
  REGION 1..1007: note = Description of Unknown: uncultivated organism with predicted taxonomy: Olsenella
  REGION 1..1007: note = MG14-250 effector
MESERAYLVLGLDPGIASCGFCLLDMTNHKILEMGSRLFKTPQEDKTKVSLAVTRRNARSARRNNERTKSRMKHCMDILADEGLIPEDADKTWFQSKKGDKPILKLRSCGLNRALTDREFAQVLYSLCGHRGYIPHGEGKDAETDDAEGKKVLNAIKRNTEEMAAGGYRTVGEMLHSRGKSRNRGGNYDFCVYNSQIQSEVHAIFEAQRALGNLKANEKFEDRYLECLTWEKKSSDHDKKVYDQVGTCIYFPELKRAADADVSSELCRAYEKLGHLVIVHVDGAEQRLTGEQISHYIGILFSPTPLNNNKYCKVTYSTIRSDLDLSGKSVFKGVPQEKEKDEVFVPKAWRCLRKVLANDHEDLLDRMLNDRELGDAICEALTFSSSETSLQEQLEPLGLAEDECVALSSIPFNGKLFKGYGSRSIKALSILLGAFEEPGVQTLADAEKATGLDRKRLEDRVARSELLPPYNTYDETCRNPVVLRAMGQMRHIVNAIIRIYGVPDEIHIELGRELKMSAREKEMVSKRQRANETANKNWAAIAAKILCCEPEEVPGQTIRKLAFREEQGEKDIYTNAPIDLEKLVTDNRYCEIDHVLPYSRTCDDSRANKVLVLSASNQNKRERTPYEWMSQDAGKAGTPKWSEYSARVIATVKNPRKRANLLNMDLDKDAESEFLQRNLNDTRYMSVAVKNYLEDCLQFPDDGRKTHVIAVAGGATASLRHVWGLNFGKNNEKDRTDNRHHAVDAAVIAACSTKTVQAVARASSVGRESFKHIRQSRLADTQPWKTFAEDVITERSFVIPTYMADHGVTGCVFEDFSYSLEGIDEKGYAHISRQTDRTTGECRSLKASNFEIVNETTVKLLDSMAFLRLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 924 - protein, 1006 aa, unidentified
  REGION 1..1006: note = Description of Unknown: uncultivated organism
  REGION 1..1006: note = MG14-251 effector
MAMQRPYLVLGLDPGIASCGFCLIDLANHKILLMGVRLFSVPKNRAGVSLAAERRAARSARRNNQRTKSRLKRCLTILKAAGLVPEDADRGWLQARKKDKPVIKLRAAGLDRVLSDRELAQVLYSLCEHRGYIPHGEGKEGATDDADGKKVLSAIKKNMEDMAKGGYRTVGEMLCAQGRSRNRGGNYDRCVYNSQIQEEARAIFAAQRSFGNLNVTAELEQEYMECLTSEKSSSDHDRRSYEVVGSCVYFPELKRAAKADISSELCRAYERFGHLVIVHKNGNEQTLTHEQINRYISALFMPSALQKKAQRITYATIRKDLDISGTSVFKGISHEQEKNEVFEPKAWRCLSKCLAENHGELLDRMWLDRALADSVCEALTYASTEVSLKGQLEALDLSEDECRAIKAIPFNSKIFKGYGTRSIKALSLLVGAFEDPDVRTLADAERATGLDMKRAEDRMPRSIMLPPYSAYDPTCRNPVVLRAMGQMRKIVNAIIKDHGVPDEIHIELSRNLKMSKREKDAIAKRQRSNEAANKKWAALAAGILDCEPSEVPHLVIRKLALREEQGDKDVYTGAAIDLERLVADDHYCEIDHILPYSRTGMSGWNNEVLVLAASNQKKRERTPYEWMQQDAGKSGVPAWDAYSSRVAATIGNPRKRRNLLCMDTGQEAMNGFLLRDLNDTRYMSVAIKNYLEDCLLFPEDGRKLHVTAVSGGATASLRRVWGLNTKGSDDEKTNSDTMRNAIDAAVIAACSVKTVQAVAKTRSLGRETFRHMRRSRLADTQPWETFADDVLAKCETVIPTRMAEHGVTGCALNEFVYRIDGFNEKGYAILSRQIDRATGERGVQVAGNYAPFGAGSAKLVGQTAFIRLWHDPDFGKGGRWYVEPVYYKDIPTLHDISYQPRYILSGRPRTEWPPVPEAALSRPPLILFSGDILVVGNHIARFKRLDINSQKLVMLNIFDERSLVKDFPTISRWKGDTNISIFSEDVLGKCFESVDIDSESSTFTLH

SEQ ID NO: 925 - protein, 1000 aa, unidentified
  REGION 1..1000: note = Description of Unknown: uncultivated organism with predicted taxonomy: Olsenella umbonata
  REGION 1..1000: note = MG14-252 effector
MAEQYLVLGLDPGISSCGFALLDMNNHKILEMGSHLFDAPQESKTKVSLAVGRRNARSARRNNLRTKNRQKHCMKLLKEAGLVPDDATKQWFQSAKGDRPLLELRFAALERILTNREFAQILYALSARRGYIPHGEGRISKLSDMDTSGSSDAETGKVLKAIGENNKLMVQGQFRTVGEMLYHQGKSRNKGGSYEHCVLNSQIVDEVHAIFQRQRAQQNPAATQELEDKYIENLTWEKRTLDHDARVYALVKKCKYFPSEYHAARADLSSELCSAYERLKHLRIVNADGHETALAPEQVEAYIAILFSPEPLSGRKEKVTYARIRKDLDLSAHLFFKGIDPEDEKDHEPYAPRAWRAMRKVLPTELMNRFRNDRALADAVGEALTYASSEDSLIYQLDSLDLSEAEREYILGLPFSGKIFKGYGSRSLKALGMLIDAFEEPEVTTLTEAEESSGLLGLRMSDNGMRYPLLPPYSTYDSENRNPVVLRAMGRMRRIVNAIIRIYGVPDEIHIELGRDLKRSKHEKDLISKRNRENERKNKQWRAQAAEIQGIDPDEVRPKLLKKMALWEEQGGLDAYTGHKIEFDRMISDDKYCEIDHVLPYSRTCDDSRSNKVLVLAKSNQDKRERTPYEWMTQDAQKGAPSWDEYQARVIANRHISPRKRRYLLNNNLGPDQESDFLNRNLNDDRYMSRAVKSYLEDTLIFPEDGRKKHVTAVSGGATGSLRHVWGLNFGDGNTKDRSDNRHHAVDACVIAACSEATVQAVAKARKLGAEAYKHIREDRLKDTQPWPTFADEVVARREFVIPTRMVSHGVTGQAFEDTNYRFDGLTNDTKKLGILYGNGKFTKKGNYVIGGDGNAHLVDGMAFLRLWIDPTAKKGKGKWYAEPVYYADIPAIKNGTYVPRAGKATVARNAWEAIPEAAHRTKPLVLFCGDVISMDGHTARYWSFSINTLTLKTKDLITGDDYKDFPTLGKWSKDSYPKIIQEDCLGHCYKGLVPKSSEG

SEQ ID NO: 926 - protein, 1022 aa, unidentified
  REGION 1..1022: note = Description of Unknown: uncultivated organism with predicted taxonomy: Atopobium sp. ICM42b
  REGION 1..1022: note = MG14-253 effector
MSGQSNGKTILGIDAGIASVGFCLLDIDNHQILELGSRLFDQPTEPKTDQNLSVARRQARSQRRLIARRKVRKGRCLGILKSCGLVPDDVDSGWLQSRKGDKNPLILRAEGLDRRLTDRELAQVLYLLCTHRDYIPHNADKAKTGDAAKDNERGKVLSAVGANRDKLAQLGYRTVGEMFAKEVKDDGNTAHRQGSYRNRRYKDSSGKEQSDYSHTVYMVELVDEVRQIVEAQRAFGNDRLTDSFLDTYLANMTAERGSKEKDAKVYQEQVAYCTYFPQEKRAASATLSNELANAYERLSNLRVINPDGTESCLDGVQIEQFINVLFSVKAPTLNYGKIRKTLDLSSEHYFKGIDRDRESKLEPCAPKAWRALCKSLSEKTLGHKSSLLVKMAVDRGFADTVLEAFAYASDEESFTDRVAELLANKGYDQLTDAELEDALSVPFTSRVFKGYCSRSLKALGLLLGCWEESEVSSLTEAEEASGLLQRRLADSYQRAELLPPYDSYDPTCTNPVVLRALSQMRRVINSIIKIHGIPDEIHVELSRDLKNSKAARDMIAKRQRDREKEKNALRKVIAELLSCELEDVTSNQLFRYELRQEQGDVDVYTGEQIDLMRMLLDQSYTQIDHILPYSRTAIDSRSNKVLVLSGSNAAKGERTPLEWMEEDVGAPDKDQYQSRIHSMSLPAAKKEKLLRRELTDADSRGFLDRNLNDNRYLSRAVMNWLAETLAFGDMDRRHVYAVTGAGTAILRKSWALNFGPNGLKDRNYDRHHAIDAAVIAACSVSTIQAIATAHAHERRLSESRMVSTQPWPSFAIELTQRIERVVPTHQVQHKGTGTVLQATIYGLRGMTKTNKYQIVTSGKTSTSGNLHIHPDGKSAQSIGDMAFLRLWHDSKNGKWYPEPVYYYDLPRLDSDAYVSRYITRNRSRDKWHEVPSEAMNERPLVVHRNDVLVVDGHVGRYITVDIAGGTIDVRSLLSKAKDGNLALATGFPSLSRWKDAWVVNEDCLGHCYDGFIVNSDCLAVIG

SEQ ID NO: 927 - protein, 1007 aa, unidentified; identical to SEQ ID NO: 923
  REGION 1..1007: note = Description of Unknown: uncultivated organism with predicted taxonomy: Olsenella sp. KH3B4
  REGION 1..1007: note = MG14-254 effector

SEQ ID NO: 928 - protein, 1000 aa, unidentified; identical to SEQ ID NO: 925
  REGION 1..1000: note = Description of Unknown: uncultivated organism with predicted taxonomy: Olsenella
  REGION 1..1000: note = MG14-255 effector

SEQ ID NO: 929 - protein, 800 aa, unidentified
  REGION 1..800: note = Description of Unknown: uncultivated organism with predicted taxonomy: Olsenella
  REGION 1..800: note = MG14-256 effector
MPEQLHGRTVLGIDAGIASVGFCLLDLDNHQILELGSHLFDQPTEPKTKQNLSVARRQARGQRRLIARRKVRKGRCLGILKDCGLVPADIDASWLQSRKGDKNPLILRAEGLDRRLTDRELAQVLYLLCTHRGYIPHNADKSATGDAARDNELGKVLSAVGSNREKLATSGYRTVGEMFAKEVKDDGVAAHRQGSYRNRRYKDSSGKEQGDYSHTVYMVELVDEVKQLVNAQRTFGNDKLTDAFLEAYLANMTAERGCKEKDAKVYEEQVGYCTYFPQEKRAATASLSNELANAYERFSNLRIINPDGSESRLDGMQIEQFVSALFSVKAPKVTYSKVWKALGLSSQHYFKGIDNDDKSRLEPYTPKAWRALCKSLSEKTLGHKSVLLAKMAYDRDYADAVLEAFAYASDDDSFSDRVNELLANKGYDQLTDAELEEAISVPFTSRVFKGYCSRSLKALGMLLECWEEKEITSLTEAEEASGLDRLRLSDRHERTLLLQPYDVYDPTCRNPVVLRSLSQMRRVINAIIKIHGVPDEIHVELSRDLKNSKAVKDKISNQQRRREAEKATLRRTIAELLQCEPDDVTGGQLLRYELRQEQNDQDVYTGDSIDLMRMLRDQSYTQIDHILPYSRTAIDSRSNKVLVLASSNAAKGERTPLEWMEQDANGPSIDAYQSRVHALNLPSAKKEKLLRRELTEDDAKHFLDRNLNDNRYLSRSVMNWLADTLAFDNLGHRHVYAVTGAGTAILRRHWALNFGSNGLKDRNDDRHHAIDAAVIAACSVSTIQSIATAHARGYRSSESR

SEQ ID NO: 930 - protein, 1082 aa, unidentified
  REGION 1..1082: note = Description of Unknown: uncultivated organism with predicted taxonomy: Megasphaera
  REGION 1..1082: note = MG15-1 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 931 - protein, 1113 aa, unidentified
  REGION 1..1113: note = Description of Unknown: uncultivated organism with predicted taxonomy: Selenomonas sp. AE3005
  REGION 1..1113: note = MG15-3 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGRELGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 932 - protein, 1113 aa, unidentified
  REGION 1..1113: note = Description of Unknown: uncultivated organism with predicted taxonomy: Selenomonas sp. AE3005
  REGION 1..1113: note = MG15-4 effector
MNYILGLDIGIASVGWAAVALDANDEPYKILDLNSRIFEKAEDPQNGDSLAAPRRKARGSRRRTRRRRHRMERLRHLFAREGLLSADKIEEIFHVPDDVYRLRAEGLTRCLKDEEWARVLYHIAKHRGFKSNRKSAASDADEGKVIEAVRQNAVLLKNYKTVGEMLFRDEKFQAAKRNKGGSYNFCVSRDMLSDEIGALFEAQRKAGNQHASEKFEADYHKIFADQRNFDDGPDINSHSPYAGNQIENMIGNCSLEPSEKRAPKASYSFMRFALLQKINHLRLKKAKGEERFLNDEERAAVEELAWKTASLTYGAVRKALSLSDEWRFTDLYYRWGKTQEEIEKKKLQFTVPYHEIRKALDKREKGRIQKLTPDALDAIGYIFTVFKNDAKIAEALKSAGIGEEDAAALMAAGLTFSGFGHISVKACRKLIPNFEKGMTYDKACKEEGYEFQGKSGEKTKFLSGNLEEIREIPNPVVRRAIAQTVKVINAVIRRYGSPVGVNVELAREMGRTFQARRDMMKSMEDNSAKNEKLKEELKGYGVMHPSGLDIVKLKLYKDQGGVCAYSLAAMPIEKVFKEHDYAEVDHILPYSRSFDDSYSNKVLVLTKENRDKGNRTPMEYMANMPGRKHDFITWVNSSIRDFRKRDNLLLENFDEEREDAWKERHLTDTQYISRFVKNLLDEHLEFAPWLSGKKQHVIAVNGAVTDYTRKRLGIRKIREDGDLHHAVDAAVIATVTQGNIQKLTNYSKRIECACIKNSDGSYTNPDTGEILKKDELIVQMSKHFPEPWPKFRHELEARVSDHPKELIESLKLPSYSMEEIDALKPPFVSRMPTRKVRGAAHLETVVSPRLQNEGMILKKVPLESLKLTKEKDAIENYYAPESDRLLYEALLHRLQAFEGNGKKAFAEEFHKPKADGMPGPVVKKVKVAEKSTLSVPVHQGKGLAANGGMVRIDVFFIPEGREHGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 933 - protein, 1078 aa, unidentified
  REGION 1..1078: note = Description of Unknown: uncultivated organism with predicted taxonomy: Veillonellales
  REGION 1..1078: note = MG15-6 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRVLTEKVSPSDWARLLIFFAKHRGFQSNRKNEKSGEDGLMLAAIGENKKILENYRSVGDMLYSDEKFKDCKRNKGGTYRFTVSRSMLKEEVQILFKKQRELGQTFAGEDLEDEYLSIFSAQRNFDEGPGANSPYAGDQIEKMIGDCTFEDGENGRPLQKRAPKASYAFMAFNLWQKINHIRVNSKGIQRSLETEEKNKIADLAWTKENITYHDLRQITGLDEETRFSEVTYPLDSTTEEAEKKVKFSWVKPYHAMRRALDKVEKNYIRKLSREEIDAIAYAFTVYKNDKKIRTALTEKGIKENVADVLITHLDGFSKFGHLSEYACYKLLPFLEKGEEYYKACDSAGLIESPARKIKDITNPVVKRAVTQTMKVIKAVQRKYGNPVEVHIELARELARSFKDRAAMDHRMKENYAKNEKIKERLSKEFHIMNPTGQDIVKWKLYEQQQGCCAYSQKPFDVDRLLHDGNYAEVDHILPYSRSFDDTYRNKVLVLEKENRDKGNRTPMEYLADKPERKEKFIAWVKTVIKDSKKREHLLRVKYGRDEEAEWKQRHLQDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEVRVSEDPEEAIRRLRLPAYENVGEIKKPFVSRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGKGVAYNDMMVRIDIFGVNEKGKNAYYFVPVYVSDTVKKELPCRGVVKRKSYENWKIMDDKDFLFSLYHNDMIHVVSKKPLSFTAAKGSSLLPKMETKDTYVYYKGADIKGVSITVINHDNSYGIKGMGIKTLLQLEKCEVDVLGNISFVKQEKRQGFR

SEQ ID NO: 934 - protein, 861 aa, unidentified
  REGION 1..861: note = Description of Unknown: uncultivated organism with predicted taxonomy: Megasphaera stantonii
  REGION 1..861: note = MG15-7 effector
ADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLKEGGIEKADREALLERLSGFSKFGHLSLKACYKILPFLEKGEVYSRACERAGYDFSKSSLENINDIPNPVVKRSISQTLKVINAIILQYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTATTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 935 - protein, 1084 aa, unidentified
  REGION 1..1084: note = Description of Unknown: uncultivated organism with predicted taxonomy: Dialister
  REGION 1..1084: note = MG15-8 effector
MNYVLGLDVGITSCGWAVLELNPEDEPVRIVDLNSRIFDKAEAGNGDSLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGNCTFEDGKNDRPPQKRAPKASYAFMAFNLWQKINHIRVNCKGIERSLETEEKNKIAGLAWTKENITYHDLRQITGLDEETRFSGVTYPLDSTTEEAEKKVKFSWVKPYHAMRRALDKVEKNYIRKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHLQDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRKVRGAAHKETVRSGKLREDGYTILKTDLSALKLKNGEIEGYYRPESDRLLYEALKKRLEAFGGKGKEAFKEPFYKPKADGTPGPLVKKVKIIEKSSLNVPVHKGKGIAYNDTMVRIDIFGVNEKGKNAYYFVPVYVSDTVKKELPCRAVVSKKPYEEWKVMDDKDFLFSLYPNDMIHVVAKTPLSFTVAEGADLAPTMETKDTYVYYKKAAISVGTITVITHDNSYGIKSMGIKTLLQLEKCEVDVLGNISFVKQEKRQGFR

SEQ ID NO: 936 - protein, 1081 aa, unidentified
  REGION 1..1081: note = Description of Unknown: uncultivated organism with predicted taxonomy: Dialister invisus
  REGION 1..1081: note = MG15-9 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 937 - protein, 1082 aa, unidentified
  REGION 1..1082: note = Description of Unknown: uncultivated organism with predicted taxonomy: Dialister
  REGION 1..1082: note = MG15-10 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQCLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 938 - protein, 1082 aa, unidentified
  REGION 1..1082: note = Description of Unknown: uncultivated organism with predicted taxonomy: Dialister
  REGION 1..1082: note = MG15-11 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKLYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 939 - protein, 1103 aa, unidentified
  REGION 1..1103: note = Description of Unknown: uncultivated organism with predicted taxonomy: Megasphaera micronuciformis
  REGION 1..1103: note = MG15-12 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKKYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 940 - protein, 1081 aa, unidentified
  REGION 1..1081: note = Description of Unknown: uncultivated organism with predicted taxonomy: Megasphaera sp. AM44-1BH
  REGION 1..1081: note = MG15-13 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAQEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLGEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETIENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 941 - protein, 1081 aa, unidentified
  REGION 1..1081: note = Description of Unknown: uncultivated organism with predicted taxonomy: Dialister
  REGION 1..1081: note = MG15-14 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 942 - protein, 1104 aa, unidentified
  REGION 1..1104: note = Description of Unknown: uncultivated organism with predicted taxonomy: Megasphaera micronuciformis
  REGION 1..1104: note = MG15-15 effector
MDTKELKYVVGLDIGITSVGWATLLLDSQDEPVRILDLNSRIFDKAEVPKTGASLAAPRRMARGVRRRLRRRKFRLYRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFTEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFDGKGKDAFKEPFHKPKSDGSPGPIVKKCKVLDKINLAVPVHDGKGITKNAGGSMIRVDIFKVKKSNGGHQYYSVPIYVADTVKEALPNRAVVAYKEYDEWKIVDDKDFVFSLYPNDLLFIGGKEIKLNGTGGDTLHQGIMVQDVFLYYRGLNIAVGSIGVENSDGRYAQDSLGIKQLPIIEKYEVSVLGDLVKAMYRTRETFKHKAQRAK

SEQ ID NO: 943 - protein, 840 aa, unidentified
  REGION 1..840: note = Description of Unknown: uncultivated organism with predicted taxonomy: Megasphaera stantonii
  REGION 1..840: note = MG15-16 effector
MNYVLGLDIGITSVGWAVLELDTHDEPIRIVDLNSRIFEKAEVPKTGESLAAPRRMARSARRLTRRRRFRLHRMRRYLIRNRILDARQVEELYVDSIGKTDIYELRYQALSQPVSNSDWARLLIFFAKHRGFKSNRKHISDSGDKGQMLNAITENQEILNNYHTVGEMLYKNEKFKACKRNKGGSYAFTVSRDMLADEIHALFDVQRSLGQAYASEELEEEYMELFSAQRNFDEGPGMNSPYSGNQIEKMIGCCTFEDDEKRAPKASYAFMAFNVWQKINHLRVTCEGTDRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIELADAEALLENISGFSKFGHLSVKACYKLLKPLKQGNVYTKACEIAGYDPQKSSQGNISDIPNPVVKRALSQALKVIKAIIRQYGCPPVEIHIELARELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKM

SEQ ID NO: 944 - protein, 1082 aa, unidentified
  REGION 1..1082: note = Description of Unknown: uncultivated organism with predicted taxonomy: Dialister
  REGION 1..1082: note = MG15-17 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 945 - protein, 1103 aa, unidentified
  REGION 1..1103: note = Description of Unknown: uncultivated organism with predicted taxonomy: Megasphaera micronuciformis
  REGION 1..1103: note = MG15-18 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEIGLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQAMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFYKPKSDGSLGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 946 - protein, 1104 aa, unidentified
  REGION 1..1104: note = Description of Unknown: uncultivated organism with predicted taxonomy: Megasphaera micronuciformis
  REGION 1..1104: note = MG15-19 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYFSGDEARKKQFVAWVKSDIKKPRKRENLLREKFTADAENDWKIRHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIEKYEVSVLGDLVKATYRPRETFNHKAQRSK

SEQ ID NO: 947 - protein, 1082 aa, unidentified
  REGION 1..1082: note = Description of Unknown: uncultivated organism with predicted taxonomy: Dialister
  REGION 1..1082: note = MG15-20 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLILVDAGKEIPFKAALKGSTLDPEKKASRFLMYYKGADIATGSISGVNHDETYKARGVGIQSLREIKKCCIDVLGNISFASKEKRQTFR

SEQ ID NO: 948 - protein, 1081 aa, unidentified; identical to SEQ ID NO: 940
  REGION 1..1081: note = Description of Unknown: uncultivated organism with predicted taxonomy: Dialister
  REGION 1..1081: note = MG15-21 effector

SEQ ID NO: 949 - protein, 1082 aa, unidentified
  REGION 1..1082: note = Description of Unknown: uncultivated organism with predicted taxonomy: Dialister
  REGION 1..1082: note = MG15-22 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKSKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 950 - protein, 1082 aa, unidentified
  REGION 1..1082: note = Description of Unknown: uncultivated organism with predicted taxonomy: Dialister
  REGION 1..1082: note = MG15-23 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKIEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 951 - protein, 1081 aa, unidentified
  REGION 1..1081: note = Description of Unknown: uncultivated organism with predicted taxonomy: Dialister invisus
  REGION 1..1081: note = MG15-24 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADSAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 952 - protein, 1081 aa, unidentified
  REGION 1..1081: note = Description of Unknown: uncultivated organism with predicted taxonomy: Dialister
  REGION 1..1081: note = MG15-25 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGIASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 953 - protein, 1082 aa, unidentified
  REGION 1..1082: note = Description of Unknown: uncultivated organism with predicted taxonomy: Dialister
  REGION 1..1082: note = MG15-26 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 954 - protein, 1082 aa, unidentified
  REGION 1..1082: note = Description of Unknown: uncultivated organism with predicted taxonomy: Dialister
  REGION 1..1082: note = MG15-27 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRGGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRGNGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 955 - protein, 1082 aa, unidentified
  REGION 1..1082: note = Description of Unknown: uncultivated organism with predicted taxonomy: Dialister
  REGION 1..1082: note = MG15-28 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 956 - protein, 784 aa, unidentified
  REGION 1..784: note = Description of Unknown: uncultivated organism with predicted taxonomy: Dialister invisus
  REGION 1..784: note = MG15-29 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRY

SEQ ID NO: 957 - protein, 1081 aa, unidentified; identical to SEQ ID NO: 940
  REGION 1..1081: note = Description of Unknown: uncultivated organism with predicted taxonomy: Megasphaera sp. AM44-1BH
  REGION 1..1081: note = MG15-30 effector

SEQ ID NO: 958 - protein, 1082 aa, unidentified
  REGION 1..1082: note = Description of Unknown: uncultivated organism with predicted taxonomy: Dialister
  REGION 1..1082: note = MG15-31 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGEKSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKRTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIINKVSRYSKSRELWDYEVDMETGEVLQKKNKNTKDVFPEPWLNFRYELEQKVRVRPLNIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 959 - protein, 1082 aa, unidentified; identical to SEQ ID NO: 953
  REGION 1..1082: note = Description of Unknown: uncultivated organism with predicted taxonomy: Veillonellales
  REGION 1..1082: note = MG15-32 effector

SEQ ID NO: 960 - protein, 1081 aa, unidentified
  REGION 1..1081: note = Description of Unknown: uncultivated organism with predicted taxonomy: Dialister
  REGION 1..1081: note = MG15-33 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALNKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 961 - protein, 1081 aa, unidentified; identical to SEQ ID NO: 951
  REGION 1..1081: note = Description of Unknown: uncultivated organism with predicted taxonomy: Megasphaera
  REGION 1..1081: note = MG15-34 effector

SEQ ID NO: 962 - protein, 1084 aa, unidentified
  REGION 1..1084: note = Description of Unknown: uncultivated organism with predicted taxonomy: Megasphaera
  REGION 1..1084: note = MG15-35 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQPVSNSDWARLLIFFAKHRGFKSNRKHISGSGDEGQMLNAITENQEILKNYRTVGEMLYKNEKFKACKRNKGGSYTFTVSRAMLADEIHTLFDVQRNLGQAYASEKLKEEYMELFSAQRNFDKGPGINSPYSGNQIEKMIGSCTFEDGEKRAPKASYAFMAFNVWQKINHLRVTCEGTYRFLSQTEKETLAALAWKKENITFKDIRRELKLDDTVRFLDVNYNLDKYKEEAEKKVKFSWVKEYHAIRKALDKVKKDRISELSHEQIDTIAYAFTVYKNDEAIKRYLLEHAIELADAEALLENISGFSKFGHLSVKACYKLLEPLQQGHVYTKACEIAGYDPQKSNQENINDIPNPVVKRALSQALKVIKAIIRQYGCPPVEIHIELARELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTIVDQETGEVLQTANPRKTDPFPEPWPKFRQELEARVSDNPAEAIAALRLPTYEGIVTISAPFVSRMPNRKVHGPAHMETIRSAKMQQDGYTMVKTELTNLKLKDGEIEGYYNPSSDKILYDALKRRLEQFGGDGNKAFKDPFYKPKSDGTPGPEVKKVKIMTKSSLNVAVNQGKGVADNGSMVRIDVFGVEERGKNAYYFVPIYVADTVRETLPNKAVVPNKSYNDWKFMRDEDFLFSLYPNDLIYIESLSPVSFHTVKGCTLVPKIERKEMLLYYRKAGISTASITVLNHDNTYVKESLGIKTIGKLQKCTVDILGNVHYVQKEKRLGFK

SEQ ID NO: 963 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-36 effector

SEQ ID NO: 964 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-37 effector

SEQ ID NO: 965 - protein, 1112 aa, unidentified
  REGION 1..1112: note = Description of Unknown: uncultivated organism with predicted taxonomy: Selenomonas bovis
  REGION 1..1112: note = MG15-38 effector
MDRRYALGLDIGIASVGWAVLAFDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDVRFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 966 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-39 effector

SEQ ID NO: 967 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-40 effector

SEQ ID NO: 968 - protein, 1089 aa, unidentified
  REGION 1..1089: note = Description of Unknown: uncultivated organism with predicted taxonomy: Megasphaera sp. AM44-1BH
  REGION 1..1089: note = MG15-41 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIQTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDPFPEPWPHFRQELEARVGKQPQEAIAALHLPTYKNVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 969 - protein, 898 aa, unidentified
  REGION 1..898: note = Description of Unknown: uncultivated organism with predicted taxonomy: Veillonellales
  REGION 1..898: note = MG15-42 effector
GEEKRALFEGQPQWGQAYAAEELEKEYIEIFGAQRNFDEGPGAGSPYGGDQIEKMIGTCTFEPMEKRAPKVSYGFMAFNLWQKINHLGLIANGVAPSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 970 - protein, 1082 aa, unidentified
  REGION 1..1082: note = Description of Unknown: uncultivated organism with predicted taxonomy: Veillonellales
  REGION 1..1082: note = MG15-43 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRIRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 971 - protein, 898 aa, unidentified; identical to SEQ ID NO: 969
  REGION 1..898: note = Description of Unknown: uncultivated organism with predicted taxonomy: Veillonellales
  REGION 1..898: note = MG15-44 effector

SEQ ID NO: 972 - protein, 1112 aa, unidentified; identical to SEQ ID NO: 965
  REGION 1..1112: note = Description of Unknown: uncultivated organism with predicted taxonomy: Selenomonas bovis
  REGION 1..1112: note = MG15-45 effector

SEQ ID NO: 973 - protein, 1081 aa, unidentified
  REGION 1..1081: note = Description of Unknown: uncultivated organism with predicted taxonomy: Dialister
  REGION 1..1081: note = MG15-46 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 974 - protein, 1078 aa, unidentified
  REGION 1..1078: note = Description of Unknown: uncultivated organism with predicted taxonomy: Dialister
  REGION 1..1078: note = MG15-47 effector
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRALTEKVSPSDWARLLIFFAKHRGFQSNRKNEKSGEDGLMLAAIGENKKVLENYRSVGDMLYSDEKFRDCKRNKGGTYRFTVSRSMLKEEVQTLFKTQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYYDLRQITGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGEGAAYNKIRIRIDIFGVNEKGKMAYYFVPVYVSDTVKRELPCRAVVQDKSYENWKMMDDKDFLFSLYPNDMIHVVAKRDLSFTAAEGSSLAPKMKTKDAYVYYKGADINGGTITVINHDNSYGIKSMGIKTLLQMEKCEVDILGNISVVKQEKRQGFR

SEQ ID NO: 975 - protein, 1112 aa, unidentified; identical to SEQ ID NO: 965
  REGION 1..1112: note = Description of Unknown: uncultivated organism with predicted taxonomy: Selenomonas bovis
  REGION 1..1112: note = MG15-48 effector

SEQ ID NO: 976 - protein, 1081 aa, unidentified
  REGION 1..1081: note = Description of Unknown: uncultivated organism with predicted taxonomy: Dialister
  REGION 1..1081: note = MG15-49 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 977 - protein, 1082 aa, unidentified
  REGION 1..1082: note = Description of Unknown: uncultivated organism with predicted taxonomy: Dialister
  REGION 1..1082: note = MG15-50 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRNGAYNFTVSRAMLMEEIHTLFEIQRNLGQKFADEKLEEEYVILFAAQRKFDEGPGENSPYAGNQIEKMIGSCTFEGKKEKRAPKESYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNHILKLSHEQLDTIATAFSVYKNEETIEQYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 978 - protein, 1082 aa, unidentified; identical to SEQ ID NO: 938
  REGION 1..1082: note = Description of Unknown: uncultivated organism with predicted taxonomy: Dialister
  REGION 1..1082: note = MG15-51 effector

SEQ ID NO: 979 - protein, 1081 aa, unidentified
  REGION 1..1081: note = Description of Unknown: uncultivated organism with predicted taxonomy: Veillonellales
  REGION 1..1081: note = MG15-52 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRVPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLRRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 980 - protein, 1081 aa, unidentified; identical to SEQ ID NO: 952
  REGION 1..1081: note = Description of Unknown: uncultivated organism with predicted taxonomy: Dialister invisus
  REGION 1..1081: note = MG15-53 effector

SEQ ID NO: 981 - protein, 1081 aa, unidentified
  REGION 1..1081: note = Description of Unknown: uncultivated organism with predicted taxonomy: Dialister
  REGION 1..1081: note = MG15-54 effector
MNYVLGLDVGIASVGWAVLELNEEDNPIRIEGLGARIFDKAEVPKTGASLAAPRRMSRGIRRVIRRRRFRLQRVRSYFKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPKTADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 982 - protein, 768 aa, unidentified
  REGION 1..768: note = Description of Unknown: uncultivated organism with predicted taxonomy: Megasphaera stantonii
  REGION 1..768: note = MG15-55 effector
AGGDDGVMLKAIQQNKEVLSKYRSVGEMFDKDEKFSDHKRNKGGSYEFTVARSMLIDEIKLLFEKQRDFGSAFAEKDAEEGYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEIGLGDEASFKGLPYKWTETDKEETEGKTKFSWVKEYHTLRKVLDKVEKNRILQLSHDDIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDVKKPRKRENLLREKFTADAENDWKVRHLQDTQYISRFMLNYLQNNYELTPGNTNRKRRIIPVNGAVTAYVRKRLGISKIRENGDLHHAVDATVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADG

SEQ ID NO: 983 - protein, 1112 aa, unidentified; identical to SEQ ID NO: 965
  REGION 1..1112: note = Description of Unknown: uncultivated organism with predicted taxonomy: Selenomonas bovis
  REGION 1..1112: note = MG15-56 effector

SEQ ID NO: 984 - protein, 1081 aa, unidentified; identical to SEQ ID NO: 981
  REGION 1..1081: note = Description of Unknown: uncultivated organism with predicted taxonomy: Dialister
  REGION 1..1081: note = MG15-57 effector

SEQ ID NO: 985 - protein, 1094 aa, unidentified
  REGION 1..1094: note = Description of Unknown: uncultivated organism with predicted taxonomy: Dialister
  REGION 1..1094: note = MG15-58 effector
VDIFSKYFVQRREAIYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFQAEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 986 - protein, 1081 aa, unidentified; identical to SEQ ID NO: 973
  REGION 1..1081: note = Description of Unknown: uncultivated organism with predicted taxonomy: Dialister
  REGION 1..1081: note = MG15-59 effector

SEQ ID NO: 987 - protein, 1081 aa, unidentified; identical to SEQ ID NO: 952
  REGION 1..1081: note = Description of Unknown: uncultivated organism with predicted taxonomy: Megasphaera
  REGION 1..1081: note = MG15-60 effector

SEQ ID NO: 988 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-61 effector

SEQ ID NO: 989 - protein, 1103 aa, unidentified; identical to SEQ ID NO: 945
  REGION 1..1103: note = Description of Unknown: uncultivated organism with predicted taxonomy: Megasphaera stantonii
  REGION 1..1103: note = MG15-62 effector

SEQ ID NO: 990 - protein, 1081 aa, unidentified
  REGION 1..1081: note = Description of Unknown: uncultivated organism with predicted taxonomy: Dialister
  REGION 1..1081: note = MG15-63 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRLIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 991 - protein, 1081 aa, unidentified
  REGION 1..1081: note = Description of Unknown: uncultivated organism with predicted taxonomy: Megasphaera
  REGION 1..1081: note = MG15-64 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 992 - protein, 1082 aa, unidentified; identical to SEQ ID NO: 955
  REGION 1..1082: note = Description of Unknown: uncultivated organism with predicted taxonomy: Dialister
  REGION 1..1082: note = MG15-65 effector

SEQ ID NO: 993 - protein, 1103 aa, unidentified
  REGION 1..1103: note = Description of Unknown: uncultivated organism with predicted taxonomy: Megasphaera micronuciformis
  REGION 1..1103: note = MG15-66 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTEADKEETESKVKFSLVKEYHTLRKVLDRVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRILYEALKKRLEQFGGKGKDAFKEPFHKPKSDGSPGPIVKKCKVLDKINLAVQVHGGNGATSNANGSMIRVDIFKVKEKNDKSSYYAVPIYVADTVKSELPKKAVCQKPYDEWPEMKEADFAFSLYPNDVIYIGGKELKMNAVLGCTLETTRSMQDVNLYFKGMDISTGAIQVVNHDGTYKQRSLGIKQLPLIEKCEVSVLGDLVKAQYRPRETFKHKAQRSK

SEQ ID NO: 994 - protein, 1053 aa, unidentified
  REGION 1..1053: note = Description of Unknown: uncultivated organism with predicted taxonomy: Megasphaera stantonii
  REGION 1..1053: note = MG15-67 effector
APRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 995 - protein, 1081 aa, unidentified
  REGION 1..1081: note = Description of Unknown: uncultivated organism with predicted taxonomy: Veillonellaceae bacterium DNF00626
  REGION 1..1081: note = MG15-68 effector
MNYVLGLDVGIASVGWAVLELDEKDEPIRIIDLSSRIFDKAEVPRTGASLAQARRIARGVRRRLRRRRFRLHRVRSYLIRQSILTKEELQNIYHCSHEESIYELRYKGLSEKLSATNWGRLLLFFAKHRGFRSNRKNDQSKEDGLMLKAISENEELLKKYRTVGEMIYSDEKFKEYKRNKGGNYQFTVSRSMLIDEIKMLFETQRKLGQFFAEQELEEKYLDIFSAQRNFDEGPGGNGFYSGNQIEKKIGVCTFEKGENGENPPKRAPKASYAFMAFTLWGKINHLRINSKGTRRALTQEEKEKVAKLSWEKASINFSTIRKELQLSPEDHFIDVRYTYGKTDEECEKGTKWNYCASYHTMRKALDKVYKNRIKELMSEQDEQKQLDDIAYAFTVYKSDEKIKNYLLQCQLEEKDAEALLAGVNNFSGFGHLSNKACYKILLHLKQGYEYAKACEMAGYDFKNISLEDIKDIPNPVVKRAIIQTLKVVRAVVREYGNPVEVHIELARDLGRNFKDRDLIKSNMEKNQKKNDEIKERIVNEFGIMQPKSQDIVKLKLCEQQDNVCVYSQKSFDLHRLFEKNYVEVDHIIPYSRSFDDTYANKVLVFNKENRDKGNKLPLEYLANQPERKEKFIAWVKSHIKDRKKRDNLLRESYSAEDKNGWKQRNLQDTQYISSYLYRYLMQNITLAPGYTDRKERIISLNGVVTGYVRKRWRIPKIRANGDLHHAVDAVVIACINDRLIKRVTEYSKAKELEYTPSDSGAVKTSMKDGFPEPWYCFRQELKARLSETPDEAIRNLHLATYCNVGNIKTPFVSRMLKCKVTGQANKETIGSGRLKDEEYVIEKTLLTELKLDKNNEIEGYYRPEDDKLLYEALKKQLMNHGGKGDKAFQAPFYKPKSDGTPGPLVKKVKLKVKLNSQVHVYQGKGIAQNGDMIRIDVFCVNKKGKKAYYFVPIYVADTVKKELPGKAVVSGKPYSAWKPMDDKDFIFSLYKNNLIYIEFNKPKSFVAEEGCTLSQTVDVKKAFLYYIKADRFAGTITVVNHDNTYKTRTGIKNTLLRFKKCVVDPLGRISFVEKEKRQRFQ

SEQ ID NO: 996 - protein, 1087 aa, unidentified
  REGION 1..1087: note = Description of Unknown: uncultivated organism with predicted taxonomy: Dialister
  REGION 1..1087: note = MG15-69 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNCKGIERSLETEEKNKIVGLAWTKENITYHDLRQITGLDEETRFSGVTYPLDSTTEEAEKKVKFSWVKPYHAMRRALDKVEKNYIQKLSREEIDAIAYAFTVYKNDRKIRTALTEKGIEDNVADVLITHLDGFSKFGHLSKYACYKLLPFLKKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKLFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEETIRRLRLPSYENAGEIKKPFVSRMPRRKVRGAAHKETVRSGKLREDGCTILKTDLSALKLKNGEIEGYYRPESDRLLYEALKKRLEAFGGKGKEAFKEPFYKPKADGTPGPLVKKVKIIEKSSLNVPVHKGQGVAYNDTMVRIDIFGVNEKGKNAYYFVPVYVSDTVKKELPCRAVVAHKPYEEWKVMDDKDFLFSLYPNDMIHVVAKREIPFTAAKGSDLEPKIQIKDTFVYYVGANIATGNIAVISHDHSYEQGSMGIKTLSQLEKCEIDVLGNVSFVKQEKRQGFR

SEQ ID NO: 997 - protein, 1082 aa, unidentified; identical to SEQ ID NO: 938
  REGION 1..1082: note = Description of Unknown: uncultivated organism with predicted taxonomy: Dialister
  REGION 1..1082: note = MG15-70 effector

SEQ ID NO: 998 - protein, 1081 aa, unidentified; identical to SEQ ID NO: 973
  REGION 1..1081: note = Description of Unknown: uncultivated organism with predicted taxonomy: Dialister
  REGION 1..1081: note = MG15-71 effector

SEQ ID NO: 999 - protein, 1082 aa, unidentified; identical to SEQ ID NO: 950
  REGION 1..1082: note = Description of Unknown: uncultivated organism with predicted taxonomy: Dialister
  REGION 1..1082: note = MG15-72 effector

SEQ ID NO: 1000 - protein, 1081 aa, unidentified; identical to SEQ ID NO: 951
  REGION 1..1081: note = Description of Unknown: uncultivated organism with predicted taxonomy: Dialister invisus
  REGION 1..1081: note = MG15-73 effector

SEQ ID NO: 1001 - protein, 1081 aa, unidentified; identical to SEQ ID NO: 951
  REGION 1..1081: note = Description of Unknown: uncultivated organism with predicted taxonomy: Dialister
  REGION 1..1081: note = MG15-74 effector

SEQ ID NO: 1002 - protein, 1081 aa, unidentified; identical to SEQ ID NO: 951
  REGION 1..1081: note = Description of Unknown: uncultivated organism with predicted taxonomy: Dialister invisus
  REGION 1..1081: note = MG15-75 effector

SEQ ID NO: 1003 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-76 effector

SEQ ID NO: 1004 - protein, 1081 aa, unidentified; identical to SEQ ID NO: 981
  REGION 1..1081: note = Description of Unknown: uncultivated organism with predicted taxonomy: Dialister invisus
  REGION 1..1081: note = MG15-77 effector

SEQ ID NO: 1005 - protein, 1081 aa, unidentified; identical to SEQ ID NO: 951
  REGION 1..1081: note = Description of Unknown: uncultivated organism with predicted taxonomy: Dialister
  REGION 1..1081: note = MG15-78 effector

SEQ ID NO: 1006 - protein, 1003 aa, unidentified
  REGION 1..1003: note = Description of Unknown: uncultivated organism with predicted taxonomy: Megasphaera stantonii
  REGION 1..1003: note = MG15-79 effector
MNYVLGLDVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFLPVYVADTVKEELPNRAVLAHKPYEAWKIMKEEDFIFSLFAIDLIFVDAGKEI

SEQ ID NO: 1007 - protein, 1081 aa, unidentified; identical to SEQ ID NO: 940
  REGION 1..1081: note = Description of Unknown: uncultivated organism with predicted taxonomy: Megasphaera sp. AM44-1BH
  REGION 1..1081: note = MG15-80 effector

SEQ ID NO: 1008 - protein, 1082 aa, unidentified; identical to SEQ ID NO: 947
  REGION 1..1082: note = Description of Unknown: uncultivated organism with predicted taxonomy: Megasphaera
  REGION 1..1082: note = MG15-81 effector

SEQ ID NO: 1009 - protein, 1081 aa, unidentified; identical to SEQ ID NO: 940
  REGION 1..1081: note = Description of Unknown: uncultivated organism with predicted taxonomy: Megasphaera sp. AM44-1BH
  REGION 1..1081: note = MG15-82 effector

SEQ ID NO: 1010 - protein, 1081 aa, unidentified; identical to SEQ ID NO: 995
  REGION 1..1081: note = Description of Unknown: uncultivated organism with predicted taxonomy: Veillonellaceae bacterium DNF00626
  REGION 1..1081: note = MG15-83 effector

SEQ ID NO: 1011 - protein, 1081 aa, unidentified; identical to SEQ ID NO: 940
  REGION 1..1081: note = Description of Unknown: uncultivated organism with predicted taxonomy: Dialister
  REGION 1..1081: note = MG15-84 effector

SEQ ID NO: 1012 - protein, 1081 aa, unidentified; identical to SEQ ID NO: 940
  REGION 1..1081: note = Description of Unknown: uncultivated organism with predicted taxonomy: Dialister
  REGION 1..1081: note = MG15-85 effector

SEQ ID NO: 1013 - protein, 1082 aa, unidentified; identical to SEQ ID NO: 954
  REGION 1..1082: note = Description of Unknown: uncultivated organism with predicted taxonomy: Dialister
  REGION 1..1082: note = MG15-86 effector

SEQ ID NO: 1014 - protein, 1082 aa, unidentified; identical to SEQ ID NO: 958
  REGION 1..1082: note = Description of Unknown: uncultivated organism with predicted taxonomy: Dialister
  REGION 1..1082: note = MG15-87 effector

SEQ ID NO: 1015 - protein, 1081 aa, unidentified
  REGION 1..1081: note = Description of Unknown: uncultivated organism with predicted taxonomy: Megasphaera sp. AM44-1BH
  REGION 1..1081: note = MG15-88 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENRKKRNRIPMEYLADATERKNRFIHWVKSTIRNSRKRENLLRTDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 1016 - protein, 1082 aa, unidentified; identical to SEQ ID NO: 944
  REGION 1..1082: note = Description of Unknown: uncultivated organism with predicted taxonomy: Dialister
  REGION 1..1082: note = MG15-89 effector

SEQ ID NO: 1017 - protein, 1081 aa, unidentified; identical to SEQ ID NO: 941
  REGION 1..1081: note = Description of Unknown: uncultivated organism with predicted taxonomy: Dialister
  REGION 1..1081: note = MG15-90 effector

SEQ ID NO: 1018 - protein, 1094 aa, unidentified; identical to SEQ ID NO: 985
  REGION 1..1094: note = Description of Unknown: uncultivated organism with predicted taxonomy: Dialister
  REGION 1..1094: note = MG15-91 effector

SEQ ID NO: 1019 - protein, 840 aa, unidentified; identical to SEQ ID NO: 943
  REGION 1..840: note = Description of Unknown: uncultivated organism with predicted taxonomy: Firmicutes
  REGION 1..840: note = MG15-92 effector

SEQ ID NO: 1020 - protein, 1103 aa, unidentified
  REGION 1..1103: note = Description of Unknown: uncultivated organism with predicted taxonomy: Megasphaera micronuciformis
  REGION 1..1103: note = MG15-93 effector
MDPKELKYVVGLDIGITSVGWATLLLDSQDEPVRILDLNSRIFDKAEVPKTGASLAAPRRMARGVRRRLRRRKFRLHRVRQYILRHHILAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRFEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYMILPYLEQGLVYSDACTAAGYDFRKSAQGSIADIPNPVVKRAISQTMKVLKAIKQKYGCPPVEVHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVQVHGGNGATSNANGSMIRVDIFKVQEKNGKHSYYSVPIYVADTVKAELPKKAVYRRPYDEWPEMKEADFAFSLYPNDAIYIGGKEIKMNAMPGCTLETTRSMQDVNLYFRGMDISTGAIRVVNHDGTYEQRSLGIKQLPIIEKYEVSVLGDLVKAMYSPRETFKHKAQRAK

SEQ ID NO: 1021 - protein, 1081 aa, unidentified; identical to SEQ ID NO: 979
  REGION 1..1081: note = Description of Unknown: uncultivated organism with predicted taxonomy: Dialister
  REGION 1..1081: note = MG15-94 effector

SEQ ID NO: 1022 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-95 effector

SEQ ID NO: 1023 - protein, 1103 aa, unidentified
  REGION 1..1103: note = Description of Unknown: uncultivated organism with predicted taxonomy: Megasphaera micronuciformis
  REGION 1..1103: note = MG15-96 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGEDGVMLKAIQQNKEVLSKYRSVGEMFDKDEKFSDHKRNKGGSYEFTVARSMLEDEIKLLFEKQRDFGSAFAEKDAEEEYIDLFSAQRNFDEGPGGDSPYGGNQIEKMIGLCTFEGKNGEKRAPKASYAFMATNLWQKINQIRIIEKGTERPLIAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEETDLDSKDIDVLIEKLGTFSKFGHLSLKACYKILPYLEQGMVYSDACTAAGYDFKKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNEICAYSQKHIDAAKLFHDPNYAEVDHIIPYSRSFDDTYNNKVLVLTAENRQKGNRTPMEYLSGDEARKKQFVAWVKSDIKKPRKRENLLREKFTTDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKINLAVQVHGGKGATANANGSMIRVDIFKVQEKNGKSYYYAVPIYVADTVKSELPKKAVYRRPYDEWPEMKEADFAFSLYPNDVVYIGGKEIKMNVMPGCTLESEKSMRDEVLYFKGLDIATGTIRVVNHDGTYKQKSLGIKQLSIIEKYEVSVLGDLVKAMYSPRETFKHKAQRAK

SEQ ID NO: 1024 - protein, 1104 aa, unidentified; identical to SEQ ID NO: 946
  REGION 1..1104: note = Description of Unknown: uncultivated organism with predicted taxonomy: Megasphaera micronuciformis
  REGION 1..1104: note = MG15-97 effector

SEQ ID NO: 1025 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-98 effector

SEQ ID NO: 1026 - protein, 1104 aa, unidentified
  REGION 1..1104: note = Description of Unknown: uncultivated organism with predicted taxonomy: Megasphaera micronuciformis
  REGION 1..1104: note = MG15-99 effector
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRQLKPEEWARILLYMAKHRGFKSNRKSAAVAGGDDGVMLKAIQQNKEVLSKYRSVGEMFDKDEKFSDHKRNKDGSYEFTVARSMLEDEIKLLFEKQRDFGSVFAKKDAEEEYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEISLGDEASFKGLPYKWTETDKEETEGKAKFSWVKEYHTLRKVLDKVEKNRILQLSHDNIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVPVHDGKGITKNAGGSMVRVDVFKVKKSNGGHQYYLVPIYVSDTVKERLPNRAVMAHKEYDEWKIVDDKDFVFSLYSNDLLFIGGKEIKLNGTGGDTLHQGIMVQNVYLYYRGLNIAAGTISVEDHDSKYIQESLGVGRVPVLEKYEVSVLGDLIKAPYRPRETFKHKAQRSK

SEQ ID NO: 1027 - protein, 1103 aa, unidentified; identical to SEQ ID NO: 945
  REGION 1..1103: note = Description of Unknown: uncultivated organism with predicted taxonomy: Megasphaera stantonii
  REGION 1..1103: note = MG15-100 effector

SEQ ID NO: 1028 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-101 effector

SEQ ID NO: 1029 - protein, 1082 aa, unidentified; identical to SEQ ID NO: 953
  REGION 1..1082: note = Description of Unknown: uncultivated organism with predicted taxonomy: Megasphaera
  REGION 1..1082: note = MG15-102 effector

SEQ ID NO: 1030 - protein, 1089 aa, unidentified; identical to SEQ ID NO: 968
  REGION 1..1089: note = Description of Unknown: uncultivated organism with predicted taxonomy: Megasphaera sp. AM44-1BH
  REGION 1..1089: note = MG15-103 effector

SEQ ID NO: 1031 - protein, 1082 aa, unidentified
  REGION 1..1082: note = Description of Unknown: uncultivated organism with predicted taxonomy: Dialister
  REGION 1..1082: note = MG15-104 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEINTLFEIQRNLGQKFADEKLEEEYVILFASQRKFDEGPGENSPYAGNQIEKMIGSCTLEGKKEKRAPKASYVFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIERYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKESIRSGRLKEEGYTISKTALIDLKLTGDKEEIKGYYNKESDRLLYEALKKQLQRYGGKAKEAFKEPFHKPKADGTPGPIVNKVKIMEKSTMLIPVNDGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 1032 - protein, 1075 aa, unidentified
  REGION 1..1075: note = Description of Unknown: uncultivated organism with predicted taxonomy: Megasphaera micronuciformis
  REGION 1..1075: note = MG15-105 effector
MDTKEMKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGGDDGDMLDAIRKNKEVLSKYRSVGEMFDKDEKFSDHKRNKGGSYEFTVARSMLVDEIKLLFERQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFRKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSPGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIE

SEQ ID NO: 1033 - protein, 1082 aa, unidentified; identical to SEQ ID NO: 949
  REGION 1..1082: note = Description of Unknown: uncultivated organism with predicted taxonomy: Dialister
  REGION 1..1082: note = MG15-106 effector

SEQ ID NO: 1034 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-107 effector

SEQ ID NO: 1035 - protein, 1082 aa, unidentified; identical to SEQ ID NO: 977
  REGION 1..1082: note = Description of Unknown: uncultivated organism with predicted taxonomy: Dialister
  REGION 1..1082: note = MG15-108 effector

SEQ ID NO: 1036 - protein, 1109 aa, unidentified
  REGION 1..1109: note = Description of Unknown: uncultivated organism with predicted taxonomy: Megasphaera stantonii
  REGION 1..1109: note = MG15-109 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKMDIDIFALRTAGLDRLLEPEEWARILLYMAKHRGFKSNRKSTAVAGGDDGIMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTHLDSKDIDVLIENLGTFSKFGHLSLKACYNILPYLEQGMVYSDACTAAGYDFRKSAQGSIADIPNPVVKRAISQTMKVLKAIKQKYGCPPVEIHIEMARELAKSFDERQKMAKSIEENQSHNERIKERLQKEFNVPYPSGQDIVKLKLYEEQNETCAYSQKHMDAHRLFHEDNYAEVDHIIPYSRSFDDTYNNKVLVLTAENRQKGNRTPMEYLSGDEARKKQFVAWVKSDIKKPRKRENLLREKFTTDAENDWKIRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVTKCKVLDKINLAVQVHGGKGITKNAGGSMVRVDVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 1037 - protein, 1081 aa, unidentified; identical to SEQ ID NO: 990
  REGION 1..1081: note = Description of Unknown: uncultivated organism with predicted taxonomy: Dialister
  REGION 1..1081: note = MG15-110 effector

SEQ ID NO: 1038 - protein, 1082 aa, unidentified; identical to SEQ ID NO: 953
  REGION 1..1082: note = Description of Unknown: uncultivated organism with predicted taxonomy: Veillonellales
  REGION 1..1082: note = MG15-111 effector

SEQ ID NO: 1039 - protein, 1081 aa, unidentified; identical to SEQ ID NO: 952
  REGION 1..1081: note = Description of Unknown: uncultivated organism with predicted taxonomy: Dialister
  REGION 1..1081: note = MG15-112 effector

SEQ ID NO: 1040 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-113 effector

SEQ ID NO: 1041 - protein, 1087 aa, unidentified
  REGION 1..1087: note = Description of Unknown: uncultivated organism with predicted taxonomy: Veillonellales
  REGION 1..1087: note = MG15-114 effector
MNYVLGLDVGITSCGWAVLELNHEDEPVRIVDLNSRIFDKAEAPKTGESLAAPRRMARGIRRLTRRRKFRLHRVRGFLVRHHILTKEEIENLYITPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNSKGIERSLETEEKNKIAGLAWTKENITYHDLRQIAGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLLFLEKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGYCAYSQKPFDVNKLLHDRTYAEVDHILPYSRSFDDTYRNKVLVLTKENRDKGNRTPMEYLADKPERKGKFIAWVKTTIKDSKKREHLLRVKYGRDEEAEWKQRHLQDTQYISRFLYNYLKNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENVGEIKKPFVSRMPRRKVRGAAHKETVRSGKLRKDGYTILKTDLSALKLKNGEIEGYYRPESDRLLYEALKKRLEAFGGKGKEAFKEPFYKPKADGTPGPLVKKVKIIEKSSLNVPVHKGKGVAYNDTMVRIDIFGVNEKGKTAYYFVPVYVSDTVKKELPCRAVVAHKPYEEWKVMDDKDFLFFLYPNDMIHVVAKRDLSFTAAEGADLAPTMETKDTCVYYKAADISAGNIKVITHDNSYEKRGFGIKTLLQLEKCEVDVLGNISVVKKEKRQGFC

SEQ ID NO: 1042 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-115 effector

SEQ ID NO: 1043 - protein, 1081 aa, unidentified; identical to SEQ ID NO: 940
  REGION 1..1081: note = Description of Unknown: uncultivated organism with predicted taxonomy: Megasphaera sp. AM44-1BH
  REGION 1..1081: note = MG15-116 effector

SEQ ID NO: 1044 - protein, 1084 aa, unidentified; identical to SEQ ID NO: 962
  REGION 1..1084: note = Description of Unknown: uncultivated organism with predicted taxonomy: Megasphaera
  REGION 1..1084: note = MG15-117 effector

SEQ ID NO: 1045 - protein, 1081 aa, unidentified; identical to SEQ ID NO: 981
  REGION 1..1081: note = Description of Unknown: uncultivated organism with predicted taxonomy: Dialister
  REGION 1..1081: note = MG15-118 effector

SEQ ID NO: 1046 - protein, 1078 aa, unidentified; identical to SEQ ID NO: 974
  REGION 1..1078: note = Description of Unknown: uncultivated organism with predicted taxonomy: Dialister
  REGION 1..1078: note = MG15-119 effector

SEQ ID NO: 1047 - protein, 1104 aa, unidentified
  REGION 1..1104: note = Description of Unknown: uncultivated organism with predicted taxonomy: Megasphaera micronuciformis
  REGION 1..1104: note = MG15-120 effector
MDPKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLVFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRESAKGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLNGDEARKKQFVAWVKSDIKKPRKRENLLREKFTDDVENDWKERHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGSIVKKCKVLDKINLAVQVHGGKGITKNTGGSMVRVDVFKVKKGNGGHQYYLVPIYVADTVKEKLPNRAVVGSTSYDGWKILHDDSFVFSLYPNELVHISGKKIKLKGTGGNTKGQEINIEDAYLYYKALNISNGMITVVTHDNTYIQESLGIGRVPTLEKYEVSVLGDLVKATYRPRETFKHKAQRFK

SEQ ID NO: 1048 - protein, 1104 aa, unidentified; identical to SEQ ID NO: 942
  REGION 1..1104: note = Description of Unknown: uncultivated organism with predicted taxonomy: Megasphaera micronuciformis
  REGION 1..1104: note = MG15-121 effector

SEQ ID NO: 1049 - protein, 1081 aa, unidentified; identical to SEQ ID NO: 952
  REGION 1..1081: note = Description of Unknown: uncultivated organism with predicted taxonomy: Dialister invisus
  REGION 1..1081: note = MG15-122 effector

SEQ ID NO: 1050 - protein, 1082 aa, unidentified; identical to SEQ ID NO: 970
  REGION 1..1082: note = Description of Unknown: uncultivated organism with predicted taxonomy: Megasphaera
  REGION 1..1082: note = MG15-123 effector

SEQ ID NO: 1051 - protein, 1081 aa, unidentified
  REGION 1..1081: note = Description of Unknown: uncultivated organism with predicted taxonomy: Dialister
  REGION 1..1081: note = MG15-124 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADEKLEEEYVILFVAQRKFDEGPGENSPYAGNQIEKMIGSCTLEGKKEKRAPKASYAFMAFNLWQKINHLKINRRGSERFLTEEERRRIADLEWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFSKSSLENIDDIPNPVVKRSISQTLKVINAIILRYGNPVEVHIELARELARNFRDRKKMEKGMQENQAKNEKIRQRLISEFGVLRPKGMDIVKFRLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTINGVNHDNTYGIRIGLQQLKGIRKCRIDVLGNISFASKEKRQTFR

SEQ ID NO: 1052 - protein, 1081 aa, unidentified; identical to SEQ ID NO: 960
  REGION 1..1081: note = Description of Unknown: uncultivated organism with predicted taxonomy: Dialister
  REGION 1..1081: note = MG15-125 effector

SEQ ID NO: 1053 - protein, 1103 aa, unidentified
  REGION 1..1103: note = Description of Unknown: uncultivated organism with predicted taxonomy: Megasphaera stantonii
  REGION 1..1103: note = MG15-126 effector
MDTKELKYVVGLDIGIASVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKGAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHLQDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHKTTGQAHEDTVRGKSNVADNEYVKKVALTELKLKDGEIEGYYNRPSDRLLYEALKKRLEQFGGKGKDAFKEPFYKPKSDGSPGPIVKKCKILDKINLAVQVHGGKGATANANGSMIRVDIFKAKEKNGKYSYYAVPIYVADTVKEELPNKAVCNKEYNRWPKMKEEDFAFSLYPNDVVYIGGKEIKMNAAPGCTLETTRSIQDVNLYFRGMDISTGAIRVVNHDGTYKQKSLGIKQLPLIEKYEVSVLGDLVKAIYKPRETFKHKVRRSK

SEQ ID NO: 1054 - protein, 1081 aa, unidentified; identical to SEQ ID NO: 973
  REGION 1..1081: note = Description of Unknown: uncultivated organism with predicted taxonomy: Dialister
  REGION 1..1081: note = MG15-127 effector

SEQ ID NO: 1055 - protein, 1081 aa, unidentified; identical to SEQ ID NO: 991
  REGION 1..1081: note = Description of Unknown: uncultivated organism with predicted taxonomy: Dialister invisus
  REGION 1..1081: note = MG15-128 effector

SEQ ID NO: 1056 - protein, 1081 aa, unidentified; identical to SEQ ID NO: 991
  REGION 1..1081: note = Description of Unknown: uncultivated organism with predicted taxonomy: Dialister
  REGION 1..1081: note = MG15-129 effector

SEQ ID NO: 1057 - protein, 1081 aa, unidentified; identical to SEQ ID NO: 940
  REGION 1..1081: note = Description of Unknown: uncultivated organism with predicted taxonomy: Dialister
  REGION 1..1081: note = MG15-130 effector

SEQ ID NO: 1058 - protein, 1081 aa, unidentified; identical to SEQ ID NO: 976
  REGION 1..1081: note = Description of Unknown: uncultivated organism with predicted taxonomy: Dialister
  REGION 1..1081: note = MG15-131 effector

SEQ ID NO: 1059 - protein, 1092 aa, unidentified
  REGION 1..1092: note = Description of Unknown: uncultivated organism with predicted taxonomy: Veillonella magna
  REGION 1..1092: note = MG15-132 effector
MNYVLGLDVGITSVGWAVLELNSQDDPIRIVDLNSRIFEKAENPKNGESLALPRRQARSIRRLTRRRRFRLQRVRRYIVRSGILNKETLHRLYNTMEGLPDIYELRYRGLTQPLSAEEWSRLLIFFAKHRGFKSNRKNASDGDDGEMLSAVKANQELLKSYRTVGEMLYKNEKFKECKHNKGGSYAFTVSRAMLEDEIRALFEVQRQLGQAYAAEELEKEYIEIFGAQRNFDEGPGAGSPYGGDQIEKMIGTCTFEPMEKRAPKVSYGFMAFNLWQKINHLGLIANGVARSFTAEEKQQIADLAWSKNNLHLQHIRKELRIPEDTIFSGVNYGIRKQDTEWAKQLEEVEKKQKFNWLTPYHEMRVALDAVKKHRITELSPDQIDTIAYAFTVFKNDEKITSYLRENGIEEDDIRALLSKVKGFSKFGHLSLKACYKILPYLEEGNIYSKACELAGYDFRSSSQEQLEDIPNPVVKRAISQTLKVIKAIVRRYGNPVEVHIELARELARNFEDRRTMQKSMEDNQKRNEEIKERLVKEYNVLQPTGMDIVKFKLYEEQQGACAYSQKMFDVNRVLHDPSYSEVDHIIPYSRSFDDSYNNKVLVLTKENRDKGNRTPMEYLKDNPVRIDAFTTWVNAIVRNSRKRANLLKSSFTEDAEQEWKRRHLQDTQYISRFLYNYLRQNLPLKEGFTNRKRRIIPVNGAVTSYVRKRLGIAKIRENGDLHHAVDAVIIACVTQGVIKRVSEYSKSRELWLYQLDDGTVIDGETGEVMTGQRGHKQEPFPEPWPEFRHELEDRVSENPPELLRHLQLPAYEGIDIETIKTPFVSRMPNRKVKGQAHEETIRSGRLKYEGYTVTKVDLKNLKLKNGEIEGYYNPDSDRLLYNALKQQLEVYDGKGDKAFAEPFHKPKADGTPGPIVKKVKIMTKSNLNVPVNGGKGVADNGSMVRIDVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 1060 - protein, 1082 aa, unidentified; identical to SEQ ID NO: 953
  REGION 1..1082: note = Description of Unknown: uncultivated organism with predicted taxonomy: Dialister
  REGION 1..1082: note = MG15-133 effector

SEQ ID NO: 1061 - protein, 1103 aa, unidentified; identical to SEQ ID NO: 993
  REGION 1..1103: note = Description of Unknown: uncultivated organism with predicted taxonomy: Megasphaera micronuciformis
  REGION 1..1103: note = MG15-134 effector

SEQ ID NO: 1062 - protein, 1103 aa, unidentified; identical to SEQ ID NO: 945
  REGION 1..1103: note = Description of Unknown: uncultivated organism with predicted taxonomy: Megasphaera micronuciformis
  REGION 1..1103: note = MG15-135 effector

SEQ ID NO: 1063 - protein, 796 aa, unidentified
  REGION 1..796: note = Description of Unknown: uncultivated organism with predicted taxonomy: Megasphaera stantonii
  REGION 1..796: note = MG15-136 effector
VAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAELLKNYRTVGEMLCDNEKFRKRKRNRDGAYNFTVSRAMLIEEIHTLFEIQRNLGQKFADERLEEEYVILFVAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSSFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLCPKGMDIVKFKLCEEQNGECAYSQKHFDMEKLLKDPSYAEVDHIIPYSRSFDDSYNNKVLVLTKENREKRNRIPMEYLADAPEQKNRFIHWVKSTIRNSRKRENLLRTDYTAATENEWKRRNLQDTQYISKYLYNYLLENLELAKGYTERKRRITPVNGAVTAYIRKRLGINKIRENGDLHHAVDAVIIACATQGIVNKVSRYSKSRELWDYEVDKETGEILQKKNKNTKDVFPEPWLNFRYELEQKVRIRPLDIPETADITKMEEPFV

SEQ ID NO: 1064 - protein, 1089 aa, unidentified; identical to SEQ ID NO: 968
  REGION 1..1089: note = Description of Unknown: uncultivated organism with predicted taxonomy: Megasphaera sp. AM44-1BH
  REGION 1..1089: note = MG15-137 effector

SEQ ID NO: 1065 - protein, 1086 aa, unidentified
  REGION 1..1086: note = Description of Unknown: uncultivated organism with predicted taxonomy: Megasphaera
  REGION 1..1086: note = MG15-138 effector
MNYVLGLDIGITSVGWAVLELDTHDEPIRIVDLNSRIFEKAEVPKTGEALAAPRRMARSARRLTRRRRFRLHRVRRYLIRNDILDEQQVAVLYDDSAGKTDIYELRYQALSQPVSNSDWARLLIFFAKHRGFKSNRKHISDSGDEGQMLNAITENQELLKNYRTVGEMLYKNEKFKACKRNKGGSYTFTVSRAMLTDEIHTLFDVQRNLGQAYASEKLKEEYMELFSAQRNFDEGPGMNSPYSGNQIEKMIGCCTFEDGEKRAPKASYAFMAFNIWQKINHLRVTCEGTYRFLSQAEKETLAAFAWKKENITFKDIRNKLGLDDTVRFLDVNYNLDQYKTAEEAEKKAKFSWVKEYHAIRKALDKVKKDRISELSHEQIDAIAYAFTVYKNDEAIKSYLLEHAIELADAEALLENISGFSKFGHLSVKACYKLLEPLKQGHVYTKACEIAGYDPQKSSQGNISDIPNPVVKRALSQALKVIKAIIRQYGCPPVEIHIELARELAKNAKERTELEKAMKDNQSRNEEIKTKLHELNVMQPTGLDIVKYKLYEQQQGDCAYSQKKFDVDRLLHDSTYAEVDHIIPYSRSFDDTYRNKVLVLTKENRDKGNRTPMEYFQDKPERKEAFVRWVKRTISDGKKRNNLLRVNYSADAEKEWKDRHLQDTQYISRYLYNYLRQHIPLKEGYTDRKRRIIPVNGAVTAYVRKRLGISKIRENGDLHHAVDAVIIACVTQGVVNKISCYSKIKELRQFMTADGTIVDKETGEVLQTANPRKTDPFPEPWPKFRQELEARVSDNPAEAIAALGLPTYEGIVSISAPFVSRMPNRKVHGPAHMETIRSAKMQQDGYTMVKTDLTNLKLKDGEIEGYYNPSSDKILYDALKRRLEQFGGDSNKAFKDPFYKPKSDGTPGPEVKKVKIMTKSSLNVTVNQGKGIADNGSMIRIDVFGVEERGKNAYYFVPIYVADTVKETLPNKAVVPNKSYNDWKVMRDEDFLFSLYPNDLIYIESPTPISFHTVKGCPLVPKIERKEMFLYYRKAGISTASITVLNHDNTYVKESLGIKTIAKLQKCTVDVLGNIHYVQKEKRLGFK

SEQ ID NO: 1066 - protein, 1086 aa, unidentified
  REGION 1..1086: note = Description of Unknown: uncultivated organism with predicted taxonomy: Megasphaera
  REGION 1..1086: note = MG15-139 effector
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQQVSNSDWARLLIFFAKHRGFKSNRKHISDSGDEGQMLNAITENQEILNNYRTVGEMLYKNEKFKACKRNKGGSYAFTVSRDMLADEIHALFDVQRSLGQAYASEKLEEEYMELFSAQRNFDEGPGMNSPYSGNQIEKMIGCCTFEDGEKRAPKASYAFMAFNVWQKINHLRVTCEGTYRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIEPADAEALLENISGFSKFGHLSVKACYRLLEPLQQGHVYTKACEIAGYDPQKSNQENINDIPNPVVKRALSQALKVIKAIIRQYGCPPVEIHIELARELAKSAKERTELEKAMKDNQSRNEEIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGMIVDKETGEVLQTANPRKTDPFPEPWPKFRQELEARVSDNPAEAIAALGLPTYEGIVNISAPFVSRMPNRKVHGPAHMETIRSSKMQQDGYTMVKTELTNLKLKDGEIEGYYNPSSDKILYDALKRRLEQFGGDGNKAFKDPFYKPKSDGTPGPEVKKIKIMTKSSLNVTVNQGKGVADNGSMVRIDVFGVEEKGKNAYYFVPIYVADTVKETLPNRAVTRGEPYNNWKIMKDEDFLFSLYPNDLIYIESLSPVSFHTVKGCTLVSKIERKEMLLYYRKAGISTASITVLNHDNTYVKESLGIKTIGKLQKCTVDILGNVHYVQKEKRVGFK

SEQ ID NO: 1067 - protein, 1089 aa, unidentified
  REGION 1..1089: note = Description of Unknown: uncultivated organism with predicted taxonomy: Megasphaera sp. AM44-1BH
  REGION 1..1089: note = MG15-140 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGVMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEMLTLKHVHKKDPFPEPWPHFRQELEARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 1068 - protein, 1081 aa, unidentified
  REGION 1..1081: note = Description of Unknown: uncultivated organism with predicted taxonomy: Dialister
  REGION 1..1081: note = MG15-141 effector
MNYVLGLDVGIASVGWAVLELNEEDNPIRIEGLGARIFEKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEENLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIISVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLRRLKGIRKCRIDVLGNISLVGKEKRKTFR

SEQ ID NO: 1069 - protein, 1089 aa, unidentified
  REGION 1..1089: note = Description of Unknown: uncultivated organism with predicted taxonomy: Megasphaera sp. AM44-1BH
  REGION 1..1089: note = MG15-142 effector
MHYVLGLDIGITSVGWAVLELNIQDEPIRIVDLNSRIFERAEIPKTGESLAAPRRVARSSRRRTRRRRFRLYRIRRYLLRNQIITPSDMKILYDNCGDMKDIYTLRHEALDRAVTSKEWARLLIFFGKHRGFKSNRKSIIASGDEGAMLQAVKENQELLKAYRTVGDMLYSDTKFANAKRNKGESYTFTVSRRMLTDEIRTLFCIQRDLGQSFATPSLEDEYLSIFLAQRNFDEGPGGNSPYSGNQIEKMIGNCAFEKNEKRAPKASYAFMAFNLLQKINHLRIERKGKQRFLTQEERNNIAGLAWKKENLTFKDIRTAISLSGDELFQDVHYASEVSLEECEKKTKFNLVRSYHAMRKALDAVEKNRIQKLSHEQLDTIAYAFTVYKNDDKISSYLLAHSIEQQDVEALLAQLRTFNKFGHLSIKACYRILPYLKEGKTYAAACTSAGYDFRNSSLEEIKDIPNPVVKRAVSQTLKVIRAIIKKYGCEPVEIHIELARELARSFQNRVKMQKSMEENQSRNEKIKERLVQEYNILSPTGMDIVKFKLYEQQQGACAYSQKMFNIYQLFHDPSYAEVDHIIPYSRSFDDSYRNKVLVFTAENRNKGNRTPMEYLKNQSERKEQFITWVKNTIRDYKKRNNLLRETYTSEDEADWKRRHLQDTQYLSTYLYNYLCHVMKLTPGCTERKRRIIAVNGAVTAYVRKRLGINKIRSNGDLHHAVDAVIIACVTQGVINRISRYSKIKELQNFQTNDGQVVDSVTGEILTLKHVHKKDLFPEPWPHFRQELVARVGKQPQEAIAALHLPTYENVESIYTPFVSRMPNRKVHGPAHLETIRSSKLLYKGITIVKTSLTNLKLKDGEIQGYYNPDSDRILYQALKRRLIQFDGEGRAAFKEPFYKPRSDGSPGPMVKKVKIMTNSSLNVLLNHGRGVADNGAMVRIDVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGHVTFVGRENRQSFQLSKK

SEQ ID NO: 1070 - protein, 1103 aa, unidentified
  REGION 1..1103: note = Description of Unknown: uncultivated organism with predicted taxonomy: Megasphaera micronuciformis
  REGION 1..1103: note = MG15-143 effector
MDTKELKYVVGLDIGITSVGWATLLLDSQDEPVRILDLNSRIFDKAEVPKTGASLAAPRRMARGVRRRLRRRKFRLHRVRQYILRHHILDKVGLECLYKPKTDIDIFALRTAGLDRQLKPEEWARILLYMAKHRGFKSNRKSTADETADGDMLKAIQQNKEILSKYRSVGEMFDKDEKFSDHKRNKGGSYEFTVARSMLEDEIKLLFEKQRDFGSAFAEKDAEEEYIDLFSAQRNFDEGPGGDSPYGGNQIGKMIGLCTFEGKNGEKRAPKASYAFMATNLWQKINQIRIIKKGTELHLTAEEAGKIYEKAWNKEAMTYKDIRSEISLGDEASFKGLAYKWTETDKEETESKTKFSWVKEYHTLRKVLDKVEKNRILQLSHDEIDNIAYVFSVYKNDDKIREALEETDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHMDAHRLFHENNYAEVDHIIPYSRSFDDTYNNKVLVLTAENRQKGNRTPMEYLSGDEARKKQFVAWVKSDVKKPRKRENLLREKFTDDAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENATEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSSGPIVKKCKVLDKINLSVPVHGGKGAAANANGGMIRVDIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 1071 - protein, 831 aa, unidentified
  REGION 1..831: note = Description of Unknown: uncultivated organism with predicted taxonomy: Megasphaera stantonii
  REGION 1..831: note = MG15-144 effector
LAKAGLDCLYKPKTDIDIFALRTAGLDRLLEPEEWARILLYMAKHRGFKSNRKSTAVAGGDDGVMLKAIQQNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGLVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDRNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWPQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIV

SEQ ID NO: 1072 - protein, 1056 aa, unidentified
  REGION 1..1056: note = Description of Unknown: uncultivated organism with predicted taxonomy: Megasphaera stantonii
  REGION 1..1056: note = MG15-145 effector
EVPKTGASLAAPRRMARGVRRRLRRRKFRLHRVRQYILRHHILDKAGLECLYKPKTDIDIFALRTAGLDRLLEPEEWARILLYMAKHRGFKSNRKSASDASDDGDMLDAIRKNKEVLSKYRSVGEMFDKDEKFSDHKRNKGGSYEFTVARSMLVDEIKLLFEKQRDFGLAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEISLGDEASFKGLPYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRRRRIIPVNGAVTAYVRKRLGISKIRENGDLHHAVDAAVIAAVTQGVVNSVSRYSKRHELQYHVDEHGNCVDLVTGELMGDAFKENHKIKGFPEPWAQFRAELEARVSENAAEAIRILNLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKADGSTGPIVKKCKVLDKINLAVQVHGGKGATANANGSMIRVDIFKVQEKNGKHSYYSVPIYVADTVKAELPKKAVYRRPYDEWPEMKEADFAFSFYPNDVVYIGGKEIKMNIMPGCTLATENHVKNDFFYYKGLDIATGAMIVINHDGTYKQRGVGIKQLPLIEKYEVSVLGDLVKAPYRQRETFKRKVHGSK

SEQ ID NO: 1073 - protein, 757 aa, unidentified
  REGION 1..757: note = Description of Unknown: uncultivated organism with predicted taxonomy: Megasphaera stantonii
  REGION 1..757: note = MG15-146 effector
AEGLSRRLDDGEWVRVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGNCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKLEKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAVNVELAREMGRSFQERRDMMKSMEDNNAANEKLKEEIKKDYGIAHPNGLDIVKYKLFKEQGERCAYSLKPMDARQVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLDDHLEFAPWLTGKNRHVMAVNGAVTDYTRKRLGIRKIREDGDLHHAVDAAVIAIVTQGNIQKLTNYSKQIERSRAFAKNPDGSYSDRETGEILKKDELIVRMSKHFPEPWPGFRRELEARVSDHPKELLESLRLPTYTPEELDALKPPFVSRMPTRKVRGAAHLETVVSPRLQKEGLIV

SEQ ID NO: 1074 - protein, 913 aa, unidentified
  REGION 1..913: note = Description of Unknown: uncultivated organism with predicted taxonomy: Selenomonas ruminantium
  REGION 1..913: note = MG15-147 effector
SDDYKMTISREMLLQEIRSLFASQRNYGNPYASKDFEEAYTSIFLSQRNFDEGPGEGSPYAGNQIEKMIGKCTLEGGELRAPKASYSFMQFNLLQKLCHIRIRGKAGERALTADEIKRLESLAWSNASLNYGHFRKELCLADTERFTDVYYKTEDFVQEEKKNKIKITAAYHEIAKALKDKGKDYIATLSIDQLDAIAYAFSAYKSDSKIRDYMQAKGVLSEDVDLLLANLSGFSKFGHISIKACRKLIPYLKKGMGYIKACEAAGYKDKLVQKKKTLSGNIEEVQEIPNPVVKRAVSQTIKVINAIVRKYGSPVEIHIELAREMARSKKDRDAMTTSMEKNRAENETIKRELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDLIEKYLEMAPFNTNRKRHVVAVNGAVTAYVRKRLGIAKIREDGDLHHAVDAAVIACVTEGMINRISRYSKRREILYNNKLVDEETGEIIKGKEDFPEPWPWFRKELDARTSKNPALLLREMKLPTYTEAELENLREPYVSRMPCHKVRGAGHESKIRSPRLLKDGKTAIKTPLVELKLTNDKTKIAGYVNPESDKLLYDALYERLCKFGGKAEKAFAEPFYKPKADGGQGPLVKSVKISKLSTMNVELNKGNGIADNERRVRVDVFYVSEGKKKGYYLVPIYVADTIKPVLPKKAVKAHKAYDEWEEMKAEDFSFSLYPNDLIYIEHKTGIKFSLISKNSTLSKEINVKKGYFYYRGMDIAAGAINIENFDGVYQARGLGVKTLNCLRKGEIDILGNIRLINREYRHCFTKMKRDRYKKE

SEQ ID NO: 1075 - protein, 1098 aa, unidentified
  REGION 1..1098: note = Description of Unknown: uncultivated organism with predicted taxonomy: Selenomonas sp. AE3005
  REGION 1..1098: note = MG15-148 effector
MEQRYILGLDIGIASVGWAALALNDKDEPYRILDMNSRIFPEAEQPETGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWQGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPVKAVTRRKAYKDWDEMKSDEFLFSLYKDDLLLVRSAKDIELSFLGRKGESGNLLTTYKTREFLCYYQGTNRAACSITICNQDNTYAKESMGIKTLALLKKMQVDVLGQVSEAPAEKRQGFKQMKKDPHRRCGKNVSAPDD

SEQ ID NO: 1076 - protein, 1039 aa, unidentified
  REGION 1..1039: note = Description of Unknown: uncultivated organism with predicted taxonomy: Selenomonas ruminantium
  REGION 1..1039: note = MG15-149 effector
MDLRYVLGLDIGIASVGWAVLALDDNDEPYKIEALNSRIFEKAENPKDGSSLAAPRREARSMRRRLRRRRHRSERVRHLLVREGVLSAEEAESLCSSAIPKNAVRGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITASYHEIAKALKDKGKEYITTLSIDQLDAIAYAFSAYKSDSKIRAYMQAKGVSSEDAALLLANLSGFSKFGHISIKACRKLMPYFEKGMGYIKACEAAGYKDKLVQKRKTLSGNIKEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKGKEDFPEPWPWFRKELDARTSKNPALLIRGLKLPTYAEEELENLHEPYVSRMPCHKVRGAGHKDTIRSPRLREEGRSVTKKALTELKLTKDKIRIEGYVNPESDRLLYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNEMYGKTGVFYYCS

SEQ ID NO: 1077 - protein, 786 aa, unidentified
  REGION 1..786: note = Description of Unknown: uncultivated organism with predicted taxonomy: Selenomonas ruminantium
  REGION 1..786: note = MG15-150 effector
WDKKPEEIEKKKLPFAAPYHEIRKALDKREKGRIQKLTPGALDAIGYIFTVFKNDTKIAAALKEAGIDEADAAALMDYGLTFQGFGHISVKACRKLIPHLETGMTYDKACKEAGYDFHGKSGEKAKLLSGNLEEIREIPNPVVRRAIAQTVKVVNAVIRRYGSPVAVNVELAREMGRTFQERREMMKSMEDNNTKNEKLKEELKDYGVAHPSGLDIVKLKLYKEQGGVCAYSLAAMPIEKVLNDYDYAEVDHILPYSRSFDDSYANKVLVLAKENRDKGNRTPMEYMEKTPGKKHDFVTWVKASVRNPKKRDNLLLEKFDEDKEAAWKERHLTDTKYIGSFVANLLRDHLDFAPWLNGRKQHVLVVNGAVTDYTRKRLGIRKIREDGDLHHAVDAAVIATVTQGNIQKLTNYSKQIERSRAFDKTANGSYADRETGEVLKKDELMVRMSKHFPEPWPGFRHELEARVSDHPKELLESLRLPTYTPEELDALKPPFVSRMPTRKVRGAAHLETVVSPRLQKEGLIVKKVSLEALKLTKEKDAIENYYAPESDRLLYEALLQRLKACDGDGKKAFAEPFHKPKADGTPGPVVKKVKIAEKSTLSVPVHHGRGLAANGGMVRVDVFFIPEGKEKGYYLVPVYTSDVVCGALPMRAVIGAKPYDEWKNMKEEQFLFSLYPNDLVYIESKRGIKGKLPDKMAKKSSLLQTRTQTEGLFYYKGTDIFTASIKVVATDGTYEFRGLGVRTLQKLEKWTVDVLGGALHPLHQEVRQGFSVMKRDPHSPKTMDDC

SEQ ID NO: 1078 - protein, 1098 aa, unidentified
  REGION 1..1098: note = Description of Unknown: uncultivated organism with predicted taxonomy: Selenomonas sp. AE3005
  REGION 1..1098: note = MG15-151 effector
MEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKFGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMRHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKLNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGAPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMQVDVLGQISEAPAEKRQGFKQMKKDPHRRCGKNVSAPDD

SEQ ID NO: 1079 - protein, 1100 aa, unidentified
  REGION 1..1100: note = Description of Unknown: uncultivated organism with predicted taxonomy: Selenomonas sp. AE3005
  REGION 1..1100: note = MG15-152 effector
MEQRYVLGLDIGIASVGWAALALNDKDEPYRILDMNSRIFPVAEQSDGASLAAPRRQARGIRRRLRRRRHRLDRVRRLLVREGVLNKAGLTALYEKPVTDIYVIRYEGLERRLTPEEWARVLLFFVKHRGFKSNRLAETANDEDGQVKAALKANEELLVGYRTVGEMLYKDAKFQGHKRNKTADYQMTVSRNMLLEEIKQLFVAQREQNNGHATESFEEKYVEIFSSQRNFDEGPGGDSPYGGNLIEKMIGACTLERANGEKRAPKASYSFMRFNLLEKLSHIRITANGTMRSLTDEERRQLEQLAWRSPSLTYAHLRKALGLQETERFNDLYYSKDTAETEKKAKFSFTAAYHEIRKALDKVEKDYIKKLSPNELDVIGYAFSVFKNERNLRSYLLNNGITENICSTLLDNLKPFRKFGHISVKACRKLIPYLEKGMTYYDACKAAGYDILGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFNPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDIFYRAEGKRKGYYLVPVYVADTIKDELPIKAVTRGKPHKDWEEMNPDEFQFSLYKDDLLLVRSTKDIDMKFNEKNGEGALPPIFRTREVLVYYQATDRATASITVCNHDNTYGKRGMGVKTIALLKKMQVDVLGQVSEFPPMKRQGFKQMKKDPHRRCDRNVSASND

SEQ ID NO: 1080 - protein, 999 aa, unidentified
  REGION 1..999: note = Description of Unknown: uncultivated organism with predicted taxonomy: Selenomonas sp. AE3005
  REGION 1..999: note = MG15-153 effector
VTDIYAIRYEGLERRLTTEEWARVLLFFVKHRGFKSNRLAETANDEDGQVKDAIKANAELLVGYRTVGEMLYKDAKFQGHKRNKTADYQMTVSRNMLLEEIKQLFVAQREQNNGHATESFEEKYLEIFSSQRNFDEGPGGNSPYGGNLIEKMIGVCTLERANGEKRAPKASYSFMRFSLLEKLSHIRLTANGTTRSLTDEERSRLEQLAWQSPSLTYAHLRKALGLQETERFNDLYYSKDTAETEKKAKFSFTAAYHEIRKALDKLEKDYIKKLSPNELDVIGYAFSVFKNERNLRSYLLNNGITENVCSTLLDNLKPFRKFGHISVKACRKLIPYLETGMTYYDACKAAGYDVLGKNGCKEKFLSGGMEEVREIPNPVVRRAISQTIKVLNALIRRYGSPVEIHVELAREMARSFQDRRDMHNKMENNRKANEQIIKELRENGLLQPNGLDIVKWKLYKEQQGICAYSQKTFDVERLLHDGKYAEVDHILPYSRSFDDSYTNKVLVMAGENQHKGNRTPWEYMRDNEEKWTSFACWTNTAIRDFRKRQNLLRKNFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALNPIFVSRMPRRKVRAAAHEETIRSAKHLDEGFTVVKKKLSDLKLTKDKMAIEGYFNPSSDTLLYQALLERLQKFDGKAAKAFAEPFYKPKADGTPGPLVRTVKIAAKSVLQVDVNKGKGVTDNESMVRVDVFYRSEGKGKGYYLVPIYVADTVKDELPLKAVTPRKCYMDWETMKPEEFLFSLYKDDLLLVCSSKDIDMKLNEKNGEGVLPPIFRTREVLVYYQATDRATASITVCNHDNTYGKRGMGVKTIALLKKMHVDVLGQVSEFPPMKRQGFKQMKKDPHRRCDRNVSASND

SEQ ID NO: 1081 - protein, 963 aa, unidentified
  REGION 1..963: note = Description of Unknown: uncultivated organism with predicted taxonomy: Selenomonas ruminantium
  REGION 1..963: note = MG15-154 effector
KDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGVEEAYTTIFLSQRNFDEGPGEGSPYAGNQIEKMIGKCTLEGEELRAPKASYSFMRFNLLQKLSHIRIRGKVGERALTEEEIKRLESLAWSNASLNYGHFRKELGLADTDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLIRELKLPTYAEEELENLHEPYVSRMPCHKVRGAGHKDTIRSPRLRKEGRSVTKKPLTELKLTKDKTKIEGYVNPESDRLLYEALYEKLCQFDGDAKKAFSAPFYKPKADGGQGPLVKKVRISEVSTLNVAVHKGKGIADSDRMLRVDVYYVSEGKKKGYYLVPIYVADTLKPVLPNKAVKAHKACDEWEEMKAEDFSFSLYPNDLIYIEH

SEQ ID NO: 1082 - protein, 910 aa, unidentified
  REGION 1..910: note = Description of Unknown: uncultivated organism with predicted taxonomy: Selenomonas sp. AE3005
  REGION 1..910: note = MG15-155 effector
KANEELLTGYRTVGEMLYKDAKFQGHKRNKTADYQMTVSRNMLLEEIKQLFVAQREQNNGHATESFEEKYLEIFSAQRNFDEGPGGNSPYGGNLIERMIGTCTLERASGEKRAPKASYSFMRFSLLEKLSHIKIKTNGTTRSLTSEERRQLEQLAWQSPSLTYAHLRKALGLQDTERFNDLYYTKDIAGTEKKTKFGFTVAYHEIRKALDKMEKAYIKKLSPEDLDVIGYAFSVFKNEGNLSAYLLNHGITKDVCSILLANLKPFRKFGHISVKACRKLIPYLEQGMTYYDACIAAGYDVAGKNSRKQKFLSGGMEEVREIPNPVVRRAISQTIKVLNALIRRYGSPVEIHVELAREMARSFQDRKDMHNKMENNRKANEQIIKELRENGLLQPNGLDIVKWKLYKEQQGVCAYSQKTFDVERLLHDGKYAEVDHILPYSRSFDDSYTNKVLVMAGENQHKGNRTPWEYMSNNEEKWTAFACWTNTAIRDFRKRQNLLRKKFCSEEKEWKERHLNDTKYISRFVYNLLRNHLEFSPFMGGRNRHVLAVSGGVTAYVRKRLGINKIRANGDLHHAVDAVIIACVTQGMVNIIEQYSKAKELWEISAKEPFPEPWIGFRKELEARTSDNPAEALRRMRCKNYSEEELQALKPIFVSRMPRRKVRASAHEDTIRSAKYLDEGFTIVKKKLSDLKLTKDKMAIEGYFNPSSDTLLYQALLKRLQEFDGKAAKAFADPFYKPRADGTPGPLVRTVKIKTKSVLQVDVNKGKGVTDNKSMVRVDIFYRAEGKRKGYYLVPVYVADTIKDELPIKAVTKGKAYKDWDEMKPDEFLFSLYKDDLLLVRSVKDIELSFLGKKGELGNFLPTYKTREFLCYYQGTNRGACSITICNQDNTYAKESMGIKTLALLKKMQVD

SEQ ID NO: 1083 - protein, 1111 aa, unidentified
  REGION 1..1111: note = Description of Unknown: uncultivated organism with predicted taxonomy: Selenomonas sp. AE3005
  REGION 1..1111: note = MG15-156 effector
YLFINEIEMGRKVMEQRYILGLDIGIASVGWAALALNDKDEPYRILDMNSRIFPEAEQPKTGESLAAPRRQARGMRRRLRRRRHRLARLRSLLVREGVLSKAALAALYEKPVTDIYAVRCEGLERRLTPEEWTRVLLYFAKHRGFKSNRLAEAGNAEEGQVKEALKANAELLADYRTVGEMLYKDAKFQAHKRNKAAAYQMTVSRNMLLSEIKQLFAAQREQNNEHASEQFEEKYVEVFSSQRNFDEGPGGESPYGGNLIERMIGTCTLERAAGEKRAPKASYSFMRFSLLEKLSHIRITANGATRSLTDEERQQLEQLAWQSPSLTYAHLRKALGLHETERFNDLYYSKDIAETEKKKKIGFTAAYHEVRKALDKLEKDYIKKLSPDELDVIGYAFSVFKNEGNLRSYLLNNGIADEVCSTLLVNLKPFRKFGHISVKACRKLIPYLEQGMTYDAACRAAGYEPSGDNGLKHKFLSGAMEEVREIPNPVVRRAISQTIKVLNALIRRYGSPVEIHVELAREMARNFQDRRDMQHKMEDNRKANERIIQELRENGLLQPNGLDIVKWKLYKEQQGICAYSQKPFDVERLLHDGKYAEVDHILPYSRSLDDSYANKVLVMAGENQLKRNRTPLEYMADDEEKQNAFVCWANTSIRDLRKRQNLLRKNFHSEEKEWKDRHLNDTKYISRFVYNLLRQHLEFSPFIGGRKRHVLAVNGSVTAYVRKRLGINKIRANGDLHHAVDAVIIACVTQGMVNIIEQYSKARELWEISAKEPFPEPWPGFRKELEARTSDNPAEELRRVQVKNYTEEELQAVKPIFVSRMPRRKIRAAAHEATIHSAKHLNEGITVVKKKLSELKLTNDKMAIAGYFNPSSDKLLYQALLTRLQAFAGNAKKAFAEPFYKPRADGSPGPLVRSVKIAAKSVLQVDVNKGKGVAANDSMVRVDVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMKVDVLGQVSEAPAEKRQGFKQMKKDPHRGCGKNVSAPDD

SEQ ID NO: 1084 - protein, 861 aa, unidentified
  REGION 1..861: note = Description of Unknown: uncultivated organism with predicted taxonomy: Megasphaera stantonii
  REGION 1..861: note = MG15-157 effector
EQPKTGASLAAPRREARGSRRRTRRRRHRMERLRHLFVREGLMTADTLAALFEAPADVYQLRAEGLSRRLDAGEWARVLYHIAKHRGFKSNRKSAASDADEGKVLDAVKENAELLKNYKTVGEMLFRDEKFRDAKRNKGGSYSFCVGRDMLADEIAALFDAQRRNGNQHASEEFEKACLKIFADQRSFDDGPDINSPSPYAGNQIEKMIGSCSLEPKEKRAPKASYSFMRFSLLQKINHLRLKDAKGEERPLDDEERAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPYLEKGMTYDKACKEAGYDLQKTGGEKTKLLSGNLEEIREIPNPVVRRAIAQTVKVVNAVIRRYGSPVAINVELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGRKRHVMAVNGAVTDYTRKRLGIRKIREDGDLHHAVDAAVIAIVTQGNIQKLTNYSKRIEHAFIKNRDGSYTHPDTGEILKKDELMAQMSRHFPEPWPGFRRELEARVSDHPKELLESLRLPTYTPEEIDALKPPFVSRMPTRKVRGAAHLETVVSPRLQKEGLIVKKVSLDALKLTKEKDAIENYYAPESDRLFYEALLQRLQACDGNGK

SEQ ID NO: 1085 - protein, 764 aa, unidentified
  REGION 1..764: note = Description of Unknown: uncultivated organism with predicted taxonomy: Selenomonas ruminantium
  REGION 1..764: note = MG15-158 effector
YYKTEDFVQEEKKNKIKITAAYHEIAKALKDKGKEYITTLSIDQLDAIAYAFSAYKSDSKIRAYMQAKGVSSEDAAILLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTTRKRNVVAVNGAVTAYVRKRLGIAKIRENGDLHHAVDAAVIACVTEGMINRISRYSKRREILYNNKLVDEETGEIIKGKEDFPEPWPWFRKELDARTGKNPALLIRDLKLPTYTEAELENLHEPYVSRMPCHKVRGAGHEAKIRSPRLLKDGKTAIKTPLVKLNLTNDKTKIAGYVNPESDKLLYDALYERLCKFGGKAEKAFAEPFYKPKADGGQGPLVKSVKISKSSTMNVELNKGNGIADNERRVRVDVFYVSEGKKKGYYLVPIYVADTIKPVLPNKAVKAHKACDEWEEMKAEDFSFSLYPNDLIYIEHKTGIKFSLISKNSTLSKEINIKKGYFYYRGMDIAAGAINIENVDGVYQARGLGVKTLNCLRKGEIDILGNIRLINREYRHCFTKMKRDRYKKE

SEQ ID NO: 1086 - protein, 1102 aa, unidentified
  REGION 1..1102: note = Description of Unknown: uncultivated organism with predicted taxonomy: Selenomonas ruminantium
  REGION 1..1102: note = MG15-159 effector
MDLRYVLGLDIGIASVGWAVLALDDNDEPYKIEALNSRIFEKAENPKDGSSLAAPRREARSMRRRLRRRRHRSERVRHLLVREGVLSAEGAESLCSSAIPKNAMLGKGLHALRYEGLDRKLSPVEWSRVLLYFAKHRGFKSNRKNGTADKDEGRVLQAIAVNMELLSKYRSAGEMLYLDERFKARKRNASDDYKMTISRDMLLQEIRILFASQRNYGNPYASEGLEEAYATIFLSQRNFDEGPGEGSPYAGNQIEKMIGKCTLEEEELRAPKASYSFMRFNLLQKLSHIRIRGKVGERALTEEEIKRLESLAWSNASLNYGHFRKELGLADMDRFADVYYKTEDFVQEEKKNKIKITAAYHEIAKALKDKGKEYITTLSIDQLDAIAYAFSAYKSDSKIRAYMQAKGVSSEDAALLLANLSGFSKFGHISIKACRKLMPYLEKGMGYIKACEAAGYKDKLVQKRKTLSGNIEEVQEIPNPVVKRAVSQTIKVINAIVRQYGSPVEIHIELAREMARSKTDRDAMTSSMEKNRAANEKVKKELMEKGLLSPKGLDIVKWKLYKEQQGVCAYSQKVIDVERLLHEGTYAEVDHILPYSRSFDDSYRNKVLVLTEENRKKGNRTPMEYFADMPERKHAFVTWCKGNIRDFKKREHLLKENYDREDAGWKDRHLNDTRYITKLVKDIIEKYLEMAPFKTSRKRNVVAVNGAVTAYVRKRLGIAKIRENGDLHHAVDAAVIACVTEGMINRISRYSKRREILYNSKLVDEETGEIIKEKEDFPEPWPWFRKELDARTSKNPALLTRELKLPTYAEEELENLHEPYVSRMPCHKVRGAGHKDTIRSPRLRKEGRSVTKKPLTELKLTKDKTKIEGYVNPESDRLIYEALYEKLCQFDGDAKKAFSAPFYKPKADGGQGPLVKKVKISEVSTLNVSVHKGKGIADSDRMLRVDVYYVSEGKKKGYYLVPIYVADTLKPVLPNKAVKAHKVYDEWEEMNVEDFVFSLYPNDLVYIEHKSGFKLKVVSKKSTLQNETYGKTGVFYYCSMNISTGALNLENLDGTYQVESLGVKTLICLRKGEIDTLGNIRLLENEVRKGFSYMKKDRYRKV

SEQ ID NO: 1087 - protein, 911 aa, unidentified
  REGION 1..911: note = Description of Unknown: uncultivated organism with predicted taxonomy: Megasphaera stantonii
  REGION 1..911: note = MG15-160 effector
RRRTRRRRHRMERLRHLFVREGLMTADALAALFEAPADVYQLRAEGLSRRLDEGEWARVLYHIAKHRGFKSNRKSAASDADEGKVLDAVKENAELLKNYKTVGEMLFRDEKFRDAKRNKGGSYSFCVGRDMLADEIAALFDAQRRNGNKHASEEFEKACLKIFADQRSFDDGPDINSPSPYAGNQIEKMIGSCSLEPKEKRAPKAGYSFMRFSLLQKINHLRLKDAKGEERPLDDEECAAVEALAWKSASLTYGAIRKALSLSDDLRFTDLYYRWDKKPEEIEKKKLPFAAPYHEIRKALDKREKGRIQKLTPDALDAIGYIFTVFKNDTKIAAALKTAGVEEEDAAALMDYGLTFRGFGHISVKACRKLIPHLEKGMTYDKACKEAGYDLQKTGGEKTKLLSGNLEEIREIPNPVVRRAIAQTVKVVNAVIRRYGSPVAINMELAREMGRSFQERRDMMKSMEDNNAENEKRKEELKGYGVAHPNGLDIVKLKLYKEQGGVCAYSLAAMPIEKVLKDPSYAEVDHILPYSRSFDDSYANKVLVLAKENRDKGNRTPMEYMANLPERKHAFITWVKSNVRNPKKRDNLLLEKFDGDKEDAWKERHLNDTKYISSFVKNLLEDHLEFAPWLTGKKRHVMAVNGAVTDYTRKRLGIRKIREDGDLHHAVDAAVIAIVTQGNIQKLTNYSKRIEHAFIKNRDGSYTHPDTGEILKKGELMAQMSRHFPEPWPGFRRELEARVSDHPKALLESLRLPTYTPEELDALKPPFVSRMPTRKVRGAAHLETVVSPRLQKEGLIVKKVSLDALKLTKEKDAIENYYAPESDRLLYEALLRRLKEFDGDGKKAFAEPFHKPKADGTPGPVVKKVKIAEKSTLSVPVHHGRGLAANGGMVRVDLFFIPEGKERGYYLVPVY

SEQ ID NO: 1088 - protein, 1112 aa, unidentified
  REGION 1..1112: note = Description of Unknown: uncultivated organism with predicted taxonomy: Selenomonas sp. AE3005
  REGION 1..1112: note = MG15-161 effector
MDRRYALGLDIGIASVGWAVLALDDADNPYRIINMGTRIFDAAEHPKDGASLAAPRREARSARRRLRRRHHRIERTRKLLIREGLLTKDALQHLFDAPPEKDVYTLRFEGLECCLDGEEWARVLLFFSKHRGFRSNRIVDDEAGDEGKVLSAIRQNEERLQGYRTVGEMLARDPKFADRKRNKAEDYQLTVSRTMLEKEICTLFDAQRQWKNPHASEDFEQEYLEIFSSQRHFDEGPGGRSPYGGDQIEKMIGRCTLEPKEKRAPKASYSFQRFSLLQNINHLRIKSQNTERSLSDEERKAVEALCWKSPSVTYYKIRQEVNLPDDARFAGLYYDKAPEEVEKKTKFSYTVPYHEIRKVLDKWKKGGIQELDVHQLDTIGYAFTVYKNDDRIHRYLCGHGISDAIAEVLVQNLKSFQKFGHISLKACQKLIPFLEQGMVYSDACKAAGYAAPDAEPKKFLSGGMEEIREIPNPVVRRSLSQTVKIINAVIREYGSPVEVHIELAREMARSRQDRDKMEKDIKNNRARNEAIKKELQELGLRNPKGQDIIKWRLYKEQDGFCAYSQKQFDVERLLHDGSYAEIDHILPYSRSFDDSYHNKVLVMAAENRQKGNRTPLEYMAGEEERIHAFRIWVNSRIHDFRKRQNLLREHFDKESTEKDWKERNLNDTKYISRFIYNLIRQHLQFAPFRTDRKQHIISVNGAVTSYIRKRLGIPKIREDGDLHHAVDAVVIASITQGTIQKVTRYSREKETLYHCDSKGRLIDTSTGEILSPEEHQRRLAEKFPEPWPCFRKEIEARISHHPAENLRLLHLPTYTEEELAELEKPIFVSRMPNHKVRGAAHEKSLRSPRLQEDGIIVYSTPLTKLKLGKDNNSILNYYNPDSDRLLYTALLQRLQKFQGDAEKAFKEPFHKPKADGTLGPVVRKVKVTDKSNLNVSLNHGHSIAKNDSDGGMVRVDVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 1089 - protein, 1082 aa, unidentified
  REGION 1..1082: note = Description of Unknown: uncultivated organism with predicted taxonomy: Megasphaera
  REGION 1..1082: note = MG15-162 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKIEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRIDYTETTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 1090 - protein, 767 aa, unidentified
  REGION 1..767: note = Description of Unknown: uncultivated organism with predicted taxonomy: Megasphaera stantonii
  REGION 1..767: note = MG15-163 effector
LREVLFLDPEDRFVGLRYDLKKEKEEDLEEPVSEAEKMSFSWVKDYHSIRKALDKVEKNRILKLSHEQLDTIATAFSVYKNEETIEKYLEEGGIEKADREALLERLSGFSKFGHLSLKACYKILPFLEKGEVYSRACERAGYDFSKSSLENIDDIPNPVVKRSISQTLKVINAMILRYGNPVEVHIELARELARNFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIWNSRKRENLLRIDYTETTENEWKRRNLQDTQYISKYLYNYLRHHLVLAKGYTERKRRIIPVNGAVTAYIRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVKHDETYKARGIGIQSLRKNKKCCIDVLGNISFASKEKRQTFR

SEQ ID NO: 1091 - protein, 1038 aa, unidentified
  REGION 1..1038: note = Description of Unknown: uncultivated organism with predicted taxonomy: Megasphaera
  REGION 1..1038: note = MG15-164 effector
MNYVLGLDVGIASVGWAVLELNEEDNPIRIEGLGARIFDKAEVPKTGASLAAPRRMSRGIRRVIRRRRFRLQRVRSYLKRHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGFRYDLKKGKAENLEEPVSEAEKMSFSWVKDYHSIRKALDKVEKNRILKLSHEQLDTIATAFSVYKNEETIEKYLEEGGIGKADREALLERLSGFSKFGHLSLKACYKLLPFLEKGEVYSRACELAGYDFSKSSLENIDDIPNPVVKRSISQTLKVINAIILRYGNPVEVHIELARELARNFRDRKKMEKGMQENQAKNEKIRQRLISEFGVLRPKGMDIVKFKLCEEQNGECAYSQKHFDMEKLLRDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYGGKAKEAFKEPFHKPKADGTPGPIVNKVKIMEKSTMPVPVNGGKGLASNGNMVRIDVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTIN

SEQ ID NO: 1092 - protein, 846 aa, unidentified
  REGION 1..846: note = Description of Unknown: uncultivated organism with predicted taxonomy: Megasphaera stantonii
  REGION 1..846: note = MG15-165 effector
ENSPYAGNQIEKMIGSCTLEGKKEKRAPKASYAFMAFNLWQKINHLKINRRGSERFLTEEERRRIADLAWKKEKLTYGSLREVLFLDPEDRFVGLRYDLKKEKEEDLEEPVSEAEKMSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 1093 - protein, 1227 aa, unidentified
  REGION 1..1227: note = Description of Unknown: uncultivated organism with predicted taxonomy: Bacteroidales
  REGION 1..1227: note = MG16-2 effector
MKRILGLDLGTNSIGWALVEVDEDGKIIKILGIGSRIIPLSPDDANEFTTGKSITKNRKRTEQRTTRKCFDRYQLRRLLLTIELRKFNMLPDERLIKLPVLDLWQLRAKAATKGNRLTLPELGRVLYHLNQKRGYKHAKSDESNDKNQREYVANVNTRYANIKQLGKTIGQFFAEKLEENQVITEKGKFYTYRIKDQVFPRKAYEEEFDQIMECQREFYPEILTDKFIDKVRNEIIYYQRKLKSCKHLVSLCEFEKRAYVNKDGKVVYDGPKVAPRTSPLFQVCKIWESVNNLKIKNRKNDELYITQEQRIAMFNFLNNNEKMTLSDMYKILKIDKSDGWWGGKAIGNGLQGNTTKMQLKKALSNCQNVDELLQFNLDIVDSDKIDEETGEVLKVVSPNCEQEPLYKLWHTIYSIQDKNELKNVLQKKWGITDETTLNSLFALDFVRPGYGNKSSKFIRKILPYLQDGLMYNEACAYIGVNHSNSLTKAENDARELLEKLPQIKKNELRQPVVEKILNQMINVVNAIFDKYGNNNGIDEIRVELARELKQSREERELTDKNNRNRQKENDSNAKLIEEYGIRASRNRIQKYRMWKESRQTCFYCGQVVDVKDFLRGYDVEVEHIIPKALFFDDSFSNKVCSCRKCNSEKGERTAYDYMSSKGEDELNRYIRTVEDRCKKGEISKTKRERLLTPADKIPTDFINRQLRETQYIAKKSVEILKQICRNVWTTSGSVTDFLRHNWGYDEILHTLDFDRYKSGGLTEVIEIEHKGQKHRIERIKDWSKRLDHRHHAVDALVVACTKQSYIQRLNNLNTERDAMYQDIEAQSVEWKEKHSLLEKWIKLQPHPTVSEVTDKVDEILVSFKAGKRVATLGKRSVYKNGKKTVVQNNIIVPRGALCEESVYGQINLIEKNKPIKYLFENPSLIFKPYIKALVEERLKEYNGDTSKAISSLKNNPIYLRKDKSVVLEYGTCYKKEYVKKYSLNSIKAKDVDSIIDKHIREVVRQRLEDNNNNEKAAFASPLYADKQKQIPIKSVRCTTGINIAAPVNYNESNDPISFVKPGNNHHIAIYKDKDGKRQEHIVTFWHAVERKKYGMPVVITNPKEIWDLIIEKSLDLPESFLNCLPNSDWNYEISMQQNEMFVMGMSEDEFQDAIRNNDYKTLNKYLYRVQSVSESDYWLRLHIETMNDKTPEGNIIKKYYRIKSINTFFNFNPHKVKITLLGEIQSS

SEQ ID NO: 1094 - protein, 1165 aa, unidentified
  REGION 1..1165: note = Description of Unknown: uncultivated organism with predicted taxonomy: Bacteroidales
  REGION 1..1165: note = MG16-5 effector
MATKKILGLDLGTNSIGWALIETEDSNPKSILAMGSRIVPLSTDDSTQFAKGQAITKNADRTQKRTARKGLNRYQMRRAMLTEELRRHGMLPERTDENIMDLWRLRSDAATDGKQLSLPQIGRVLYHINQKRGYKHSKADNSANTKQTKYVEAVNQRYRDIQACHQTIGQYFYEQLLSSAVQTPSGSYYTYRIKDKVLPREAYIAEFDQIMKVQRVFYPDVLTDELVDTLRNHIIFYQRPLKSCKHLVSLCEFEKRPFKREDGQIVYSGPKCAPRTSPLAQFCTVWEAVNNITLTNRQNETFEITQEQRVAMADFLNQHDKMGVKDLQKILGISPKDGWWAGKAIGKGLKGNTTFTQLREALGNLPNAEHLLKMKLSMVDAAVDTTTGELIRQVSPQVEEEPLFRLWHLVYSLQNEDELRKALRKQFGIDDEEVLDKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYENRIREYGIQPSRSRIQKYKMWEESNHLCFYCGKPVNVTDFLAGAEVEIEHIIPQSVLFDDSYSNKVCACRACNQAKGNLTAREFMEKHSKEEYDSYLRRVDDAFNAHRISKTKRDHLLWRKEDIPQDFIDRQLLQSQYIAKKAAEILRQGYRNVYATSGSVTDFLRHQWGYDEILHRLNLPRYQQVEGLTEDVTYDHCGQEHQQERIKGWTKRLDHRHHAIDALTIALTQQSVIQRLNTLNNSREQMFDELGKRTDTPEYTEKRSLLEKWVDAQPHFSVQEVTDKVDGILVSFRAGKRAATPAKRAVYQNGKRHIVQTGLQVPRGALSEETVYGKLGNKYVVKYPLGHQSMKMDDIVDPTIREIVRTRLNAFGGKAKDAFAEPLYSDAAHQMQIKTVRCYTGLQDKAVVPVRFNAQGEPVGFVKMGNNHHIAIYRDAKGQYQESVVSFWQAVERKRYGIPVVIEQPHEVWDKLINSDNIPQDFLETLPHDDWQFVVSLQQNEMFILGMDDADFEAAMEQKDYRTLNKYLYRVQKISSKEYCFRYHTETSVDDKYDGVINKSISMELQKLKRLTSISAFFSQHPHKVRVNLLGEVSAL

SEQ ID NO: 1095 - protein, 1165 aa, unidentified; identical to SEQ ID NO: 1094
  REGION 1..1165: note = Description of Unknown: uncultivated organism with predicted taxonomy: Bacteroidetes
  REGION 1..1165: note = MG16-6 effector

SEQ ID NO: 1096 - protein, 1224 aa, unidentified
  REGION 1..1224: note = Description of Unknown: uncultivated organism with predicted taxonomy: Bacteroides
  REGION 1..1224: note = MG16-7 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEELDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1097 - protein, 1224 aa, unidentified
  REGION 1..1224: note = Description of Unknown: uncultivated organism with predicted taxonomy: Bacteroides
  REGION 1..1224: note = MG16-8 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKDHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1098 - protein, 1224 aa, unidentified; identical to SEQ ID NO: 1096
  REGION 1..1224: note = Description of Unknown: uncultivated organism with predicted taxonomy: Bacteroides sp. CAG:770
  REGION 1..1224: note = MG16-9 effector

SEQ ID NO: 1099 - protein, 1224 aa, unidentified
  REGION 1..1224: note = Description of Unknown: uncultivated organism with predicted taxonomy: Bacteroides
  REGION 1..1224: note = MG16-10 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 1100 - protein, 1224 aa, unidentified; identical to SEQ ID NO: 1099
  REGION 1..1224: note = Description of Unknown: uncultivated organism with predicted taxonomy: Bacteroides
  REGION 1..1224: note = MG16-11 effector

SEQ ID NO: 1101 - protein, 1165 aa, unidentified; identical to SEQ ID NO: 1094
  REGION 1..1165: note = Description of Unknown: uncultivated organism with predicted taxonomy: Bacteroidetes
  REGION 1..1165: note = MG16-12 effector

SEQ ID NO: 1102 - protein, 1224 aa, unidentified; identical to SEQ ID NO: 1096
  REGION 1..1224: note = Description of Unknown: uncultivated organism with predicted taxonomy: Bacteroides
  REGION 1..1224: note = MG16-13 effector

SEQ ID NO: 1103 - protein, 1224 aa, unidentified
  REGION 1..1224: note = Description of Unknown: uncultivated organism with predicted taxonomy: Bacteroides sp. CAG:770
  REGION 1..1224: note = MG16-14 effector
MKKVLGLDLGVGSIGWALVNVDETHAPVNLLGMGSRIVPLTTDDAKEFTQGNAASKNQKRTQKRTARKGYDRYQLRRQQLTDKLRSLGMLPDERLIKLPVLELWELRANAATPSYKLSLPEIGRVLYHINQKRGYRHSRDEDSDKQQRDYVAAVNNRWKEIREEGKTIGQHFANKLKETEIISEKGKFYTYRIKEQVFPRGAYMEEFDRIVEAQKVFWPDIFTDENVDELRNRIIFFQRPLKSCKHLVSLCDFEVRDFVKKNHSGNVITDRNGNQCHILAGPKVAPKSSPLSQESKLWEEINNIRITNSKNDEFFISQEKKVEIYRFLSENEVMKANDLKKILGISANDKEWTIDKAVSKGLTGNTTRTRLRKALSHFKREDLLRFDMQLTDSSFVNPETGEILHEIDPKCEQEPLYRLWHCIYSIDNKEDLAKALENQFGITNKEAIDNLNKIDFVKQGYGSKSAKFIRRILPYLQNGAMYSEACEIIGTNHSGSLTKAENAARQLLQRIPQLNKNELRQPVVEKILNQMINVVNAIAEKFGSIDEIRIEMARELKLSQEARATTAKSIRDREKINLEYAGKIREFGIVPSKNKILKYRLWEEAGQRCFYCGQTISAQEFLSGFDSDIEHIIPKSRLFDDSYSNKACSCRKCNSTKNNMTAYDFMKAQGEDKFKDYCDRVANAYKEGKISRTKRDRFMTPAEKIPKDFISRQLVQTQYISRKAMEILMQICHDVYASSGDVTAYLRRIWGYDEILQRLNIPRYREGGLTEMVTYEHNNQQHTEERIKGWSKRLDHRHHAIDALTIACTRQNIIQRLNNLNAQESSGEDKLNLDKWTMAQAHFSVREVSDAASRILISFKSGKKVATPGKRYIYRNGKRILAQENIIVPRGALSEESVYGKIRTIEKGIAINKLFDRHEDIFQPLIKKIIEERISEFDGNIKAAKASLKKRPLYLDKEKTIELKYGSCFKYEYVIKYPLNTLRAKDVEYIVDENIRETVSDRLSQFNGNVKEAFKEPLYTDGTSPVLIKTVRMFTGLDAVVPVRKDSDGKNIGFVKTGNNHHVAIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKNYYFRYQYETQLDDKEAALSMKKFYRVTSLSSLQSLNPKKVSINLLGDISLHNII

SEQ ID NO: 1104 - protein, 1221 aa, unidentified
  REGION 1..1221: note = Description of Unknown: uncultivated organism with predicted taxonomy: Bacteroides sp. CAG:770
  REGION 1..1221: note = MG16-15 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFHQRDLKSCKHLVSQCEFMTRSFLDADHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPTDKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMCVLGMEDDEFRDAMEVKDYKTLGAHLYRVQKLASIYYVFRHQYETQLDDSKGAQIMKKFYRAQSFKALFALHPRKVSVSLLGEMALKDD

SEQ ID NO: 1105 - protein, 1221 aa, unidentified
  REGION 1..1221: note = Description of Unknown: uncultivated organism with predicted taxonomy: Bacteroides sp. CAG:709
  REGION 1..1221: note = MG16-16 effector
MKKILGLDLGVGSIGWSLINADKDNKPIAILGLGSRIISLSPDESSEFTSGNAASKNQKRTQKRTARKGYDRYQMRRQALTDKLRELKMLPDEHLIKLPVLDLWTLRARAATPGERLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINELRNEIIFYQRNLKSCKHLVSRCEFMTRSFLDEEHRPVLDASGKLVISGPKVAPKSSPIFQVCKIWEEINNLSIRNKENDELHISPEQKKDIFEYLDNNEKITSAALYKILGIGKGDGWSVDKALSKGFTGNTTKVAISKALGKANDAKKRDLLRFDLRLKENGVNKDTGEIVCEIDPECENEPLYKLWHVIYSINDKDAQRHALTNQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAESLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVTSLQQNEMFVLGMEDDEFRDAMAEADYKALGAHLYRVQKLAGSDYYFRSHYETLLDDSAGARIMKKFYRVRSFNALFNLHPRKVAVSLLGEMSLKND

SEQ ID NO: 1106 - protein, 1221 aa, unidentified
  REGION 1..1221: note = Description of Unknown: uncultivated organism with predicted taxonomy: Bacteroides sp. CAG:770
  REGION 1..1221: note = MG16-17 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKVLGKDHNTKKSDLLRFDLRLKENGVNKDTGEIIYEIDPTCENEPLYRLWHVIYSINGKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTQQSIIQRLNNLSAMTAVAGESMSLDKWTLAQPHFSVQKVSDNVSRILVSFKAGKKVTTPGKRYVYRGGKRVLVQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDIEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRINSIKSLFALHPRKVSVSLLGEMALKDD

SEQ ID NO: 1107 - protein, 1220 aa, unidentified
  REGION 1..1220: note = Description of Unknown: uncultivated organism with predicted taxonomy: Bacteroides sp. CAG:770
  REGION 1..1220: note = MG16-18 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKSQFGILDESMLESLCKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1108 - protein, 1220 aa, unidentified
  REGION 1..1220: note = Description of Unknown: uncultivated organism with predicted taxonomy: Bacteroides sp. CAG:770
  REGION 1..1220: note = MG16-19 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENTISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVDVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1109 - protein, 1221 aa, unidentified
  REGION 1..1221: note = Description of Unknown: uncultivated organism with predicted taxonomy: Bacteroides sp. CAG:770
  REGION 1..1221: note = MG16-20 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLQEIGRVLYHINQKRGYRHAKSDDSADKEQHDYVQTVNKRYQEIKDEGTTIGQHFAIKLKESEIVTDKGPFYNYRIKEQVFPRDAYIEEFDRIMDCQKTFYPEELSEDNIEEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQNISSLYYVLRLQYETQVDNSNEALNMKKFHRIRSFNALFALHPRKVSVSLLGEMALKDD

SEQ ID NO: 1110 - protein, 1218 aa, unidentified
  REGION 1..1218: note = Description of Unknown: uncultivated organism with predicted taxonomy: Bacteroides sp. CAG:770
  REGION 1..1218: note = MG16-21 effector
MKKILGLDLGVGSVGWSVVSCDDEHKPVEILGMGSRIVPLTPDESSEFSSGNAASKNQSRTQKRTARKGYDRYQLRRQALTVKLRELGMLPDEALIKLPVLDLWKLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTAADVNEIRNEIIYYQRPLKSCKHLVSSCEFMQRELFDAEHNPIRNGKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYVSRKAMEILNQVCRNVYGSSGDVTAYLRRIWGYDEILHSLDLPRYREGNLTGNVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKSGKRRIAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHVREVVTARLAAFGDDPKKAFAEPLYADEAGKIQIKTVRCHTGLSQVVPVKKDADGNDIGFVKPGNNHHIAIYKDADGKYCWNVVTLWNAVDRKRYGLPIIVRNPYEISDIIIDSNVPDELASGLPDPNWSFVMSLQQNEMFVLGMSEEEFRCAIENKDYKTLGMHLYRVQKLSHLRFRSQYETRLDDSNEAKSMKKFYEIRSLKSFWFLNPHKVSISLLGEISLKDD

SEQ ID NO: 1111 - protein, 1220 aa, unidentified
  REGION 1..1220: note = Description of Unknown: uncultivated organism with predicted taxonomy: Bacteroides sp. CAG:770
  REGION 1..1220: note = MG16-22 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIDEILRFELKEVESNQVNADTGEVLMEISAECEREPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRKGNLTGDVTYVHKGQTHTEERIKDWSKRLDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSAESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1112 - protein, 1221 aa, unidentified
  REGION 1..1221: note = Description of Unknown: uncultivated organism with predicted taxonomy: Bacteroidales
  REGION 1..1221: note = MG16-23 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNRSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1113 - protein, 1221 aa, unidentified
  REGION 1..1221: note = Description of Unknown: uncultivated organism with predicted taxonomy: Bacteroides sp. CAG:770
  REGION 1..1221: note = MG16-24 effector
MKKVLGLDLGVSSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDYQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDTIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1114 - protein, 895 aa, unidentified
  REGION 1..895: note = Description of Unknown: uncultivated organism with predicted taxonomy: Bacteroides sp. CAG:770
  REGION 1..895: note = MG16-25 effector
MKKILGLDLGVGSVGWSVVSCDDEHKPVEILGMGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRFQEIMNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNRKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESVKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKKVATPGKRYVYKAGRRRVVQENILVPRGALSEESV

SEQ ID NO: 1115 - protein, 1071 aa, unidentified
  REGION 1..1071: note = Description of Unknown: uncultivated organism with predicted taxonomy: Bacteroides
  REGION 1..1071: note = MG16-26 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTY

SEQ ID NO: 1116 - protein, 1220 aa, unidentified
  REGION 1..1220: note = Description of Unknown: uncultivated organism with predicted taxonomy: Bacteroides sp. CAG:770
  REGION 1..1220: note = MG16-27 effector
MKKILGLDLGVGSVGWSVVSCDDEHKPVEILGMGSRIVPLTPAESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKNEGLTIGQHFAVKLKGSEVITDKGAFYNYRIKEQVFPRAAYVEEFDRIIQCQREFYPEVLTAADVNEIRNEIIYYQRPLKSCKHLVSSCEFMQRELFDAEHNPIRNRKGEIVVAGPKCAPKSSPLAQVCKIWEEINNIRVTNKENDEYFVGIDNKHEIFDFLNTHEKMKADDLFKILGLAKNSGWSADRAMSKGMVGNTTRVALMKALKGRRDIDDILRFDLREVESNQVNADTGEVLMEIGAECESEPLYRLWHIIYSISDKNEQKAALEKQFGITDESMLESLCRIDFVKQGYSSRSFKFMRKILPSLMDGAKYSEACDVIGINHSDSITKAENQTRKLLPKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKGNATAFDYMKGRGENAFEDYLKRVEAAFKENKISQTKRNRLLTPADKIPKDFISRQLVQTQYISRKAMEILDQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGSRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLDSIKAKDAASIVDKHIRDVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLTGGLPSPEWTFVMSMQQNEMFVLGMGDDEFNDALAGRDYKSLGEHLYRVQKLASSYYVFRSQYETKLDDSKNALMMKKYYRTQSFNALFAINPRKVSISLLGEISLKDD

SEQ ID NO: 1117 - protein, 1219 aa, unidentified
  REGION 1..1219: note = Description of Unknown: uncultivated organism with predicted taxonomy: Bacteroides sp. CAG:545
  REGION 1..1219: note = MG16-28 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDKIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLPRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHTLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1118 - protein, 1221 aa, unidentified
  REGION 1..1221: note = Description of Unknown: uncultivated organism with predicted taxonomy: Bacteroides sp. CAG:709
  REGION 1..1221: note = MG16-29 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRKSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAICRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRVRSFNALFYLHPRKVAVSLLGEMSLKND

SEQ ID NO: 1119 - protein, 1221 aa, unidentified
  REGION 1..1221: note = Description of Unknown: uncultivated organism with predicted taxonomy: Bacteroides sp. CAG:709
  REGION 1..1221: note = MG16-30 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1120 - protein, 1221 aa, unidentified
  REGION 1..1221: note = Description of Unknown: uncultivated organism with predicted taxonomy: Bacteroides sp. CAG:709
  REGION 1..1221: note = MG16-31 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVALSKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACYNDVNAACASLKKEPLYLDAEKTIPLEYGTCYKAKYVMKYALSALKPKDVEYIVDEHIRKVVSERLSEYGNDPKKAFAEPLYADDAKTIDVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1121 - protein, 1219 aa, unidentified
  REGION 1..1219: note = Description of Unknown: uncultivated organism with predicted taxonomy: Alistipes sp. CAG:514
  REGION 1..1219: note = MG16-32 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPECENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQAAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1122 - protein, 1219 aa, unidentified; identical to SEQ ID NO: 1121
  REGION 1..1219: note = Description of Unknown: uncultivated organism with predicted taxonomy: Alistipes sp. CAG:514
  REGION 1..1219: note = MG16-33 effector

SEQ ID NO: 1123 - protein, 1221 aa, unidentified
  REGION 1..1221: note = Description of Unknown: uncultivated organism with predicted taxonomy: Bacteroides sp. CAG:545
  REGION 1..1221: note = MG16-34 effector
MKKVLGLDLGVGSVGWSLVNVDDNYKPMEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQSVNKRYQEIKDEGATIGQHFAIKLKESEIVTDKGPFYNYRIKEQVFPRDAYIEEFDRIMACQKTFYPEELSDGNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLMIPRGALCEESVYGRIHSLEKEVPVKKLFERVDDIVKPGIRTAVEERLRACDNDVKVACASLKKEPLYLDAEKTIPLEYGTCYKAEYAMRYALSALKPKDVEFIVDEHIRKVVSERLSEYGNDPKKAFAEPLYADKSKMIPIRTVRCYTGLAQVVPIKKDSNGNDIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEGKDYKTLGAHLYRVQKLTSLYYVFRHQYETQLDDSKGAQIMKKFYRVRSFNAMFALHPRKVSVSLLGEMALKDD

SEQ ID NO: 1124 - protein, 1186 aa, unidentified
  REGION 1..1186: note = Description of Unknown: uncultivated organism with predicted taxonomy: Bacteroides sp. CAG:770
  REGION 1..1186: note = MG16-35 effector
MGSRIVPLTPDESNEFSSGNAASKNQSRTQKRTARKGYDRYQLRRQALTGKLRELGMLPDEALIKLPVMDLWTLRARAATPGEKLSLAEIGRVLYHLNQKRGYRHSKEDDSADKTQRDYVQAVNKRYQEIKNEGLTIGQHFAVKLKESEVITDKGAFYNYRIKEQVFPRAAYVEEFDRIIQCQREFYPEVLTEANVNEIRNEIIYYQRLLKSCKHLVSVCEFMQRELFDAEHNPIRNRKGEIVIAGPKCAPKSSPLAQVCKIWEEVNNIRITNKENDEYFISVDDRHKIFDFLNTHEKMKADDLFKILGLAKNSGWSADRAMSKGMVGNTTRVALMKALKGRRDIEEVLRFDLSAVESNQVNADTGEVLMEISAECEREPLYRLWHIIYSISDKNEQKSALKNQFGISDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIACTRQSIIQKLNTLNAKTAIGEEQISLDKWTLAQAHFSVADVADHVADILVSFKSGKKVATPGKRYVYKAGRRSVAQENILVPRGALSEESVYGRIKSIEEKVPVKKLFERADDIVKPRIRHLIGERLEACGGDCSKAVSSLRKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1125 - protein, 1221 aa, unidentified
  REGION 1..1221: note = Description of Unknown: uncultivated organism with predicted taxonomy: Bacteroides
  REGION 1..1221: note = MG16-36 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDKILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1126 - protein, 1221 aa, unidentified
  REGION 1..1221: note = Description of Unknown: uncultivated organism with predicted taxonomy: Bacteroides sp. CAG:545
  REGION 1..1221: note = MG16-37 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1127 - protein, 1221 aa, unidentified; identical to SEQ ID NO: 1125
  REGION 1..1221: note = Description of Unknown: uncultivated organism with predicted taxonomy: Bacteroides
  REGION 1..1221: note = MG16-38 effector

SEQ ID NO: 1128 - protein, 1220 aa, unidentified
  REGION 1..1220: note = Description of Unknown: uncultivated organism with predicted taxonomy: Bacteroides sp. CAG:770
  REGION 1..1220: note = MG16-39 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIYEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRRLIRERLETFGGDCSKAVSSLKKSPLYLDEENTIMLEYGSCFKPEYVIKYSLNSIKAKDAVSIVDKHIREVVTARLAAFGDDPKKAFAEPLYSYASGKIQIKTVRCYTGLSQVVPVKRDADGNDIGFVKPGNNHHIAIYKDADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1129 - protein, 1221 aa, unidentified
  REGION 1..1221: note = Description of Unknown: uncultivated organism with predicted taxonomy: Bacteroides sp. CAG:770
  REGION 1..1221: note = MG16-40 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGRHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSIIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLASSYYVFRHQYETQLDDSKCAQIMKKFYRAQSFKALFALHPRKVSVSLLGEMALKDD

SEQ ID NO: 1130 - protein, 1220 aa, unidentified
  REGION 1..1220: note = Description of Unknown: uncultivated organism with predicted taxonomy: Bacteroides sp. CAG:770
  REGION 1..1220: note = MG16-42 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVQDLWTLRARAATLGNKLSLPEIGRVLYHLNQKRGYRHSKQDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSSCEFMQRELFDAEHNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKQFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLLPSKNKILKYRLWEESGKRCFYCGQPVSATEFLNGLDVEIEHVVPKSLLFDDSFSNKVCACRKCNAEKGNATAFDFMNGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHMGQTHTEERIKDWSKRLDHRHHAIDALTIACTRQSIIQRLNTLNAKTAIGEEQMSLDKWTLAQAHFSVADVSDHVADILVSFKSGKKVTTPGKRCVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAASIVDKHIRDVVIARFAAFGDDPKKAFAEPLYADEAGKIQIKTVRCYTGLSQVVPVKKDAAGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDALAGRDYKSLGEHLYRVQKLATSDYFFRSQYETKLDDSKGASAMRKFYRTASLKALFALNPRKVSISLLGEISLKDD

SEQ ID NO: 1131 - protein, 1220 aa, unidentified; identical to SEQ ID NO: 1130
  REGION 1..1220: note = Description of Unknown: uncultivated organism with predicted taxonomy: Bacteroides sp. CAG:770
  REGION 1..1220: note = MG16-43 effector

SEQ ID NO: 1132 - protein, 1232 aa, unidentified
  REGION 1..1232: note = Description of Unknown: uncultivated organism with predicted taxonomy: Bacteroides sp. CAG:770
  REGION 1..1232: note = MG16-44 effector
CGSYRSGLSDRAYISRVHLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDAEHNPIRNGKGEIIVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEISAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1133 - protein, 1186 aa, unidentified; identical to SEQ ID NO: 1124
  REGION 1..1186: note = Description of Unknown: uncultivated organism with predicted taxonomy: Bacteroides sp. CAG:770
  REGION 1..1186: note = MG16-45 effector

SEQ ID NO: 1134 - protein, 1221 aa, unidentified
  REGION 1..1221: note = Description of Unknown: uncultivated organism with predicted taxonomy: Bacteroides sp. CAG:770
  REGION 1..1221: note = MG16-46 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNLRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSLYYVFRHQYETQLDDSKGAQIMKKFYRVRSFNAMFALHPRKVSVSLLGEMALKDD

SEQ ID NO: 1135 - protein, 1221 aa, unidentified
  REGION 1..1221: note = Description of Unknown: uncultivated organism with predicted taxonomy: Bacteroides sp. CAG:709
  REGION 1..1221: note = MG16-47 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRTLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKSDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHRISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAEYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRIQSFKALFALHPRKVAVSLLGEMSLKND

SEQ ID NO: 1136 - protein, 1220 aa, unidentified
  REGION 1..1220: note = Description of Unknown: uncultivated organism with predicted taxonomy: Bacteroides sp. CAG:770
  REGION 1..1220: note = MG16-48 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1137 - protein, 1191 aa, unidentified
  REGION 1..1191: note = Description of Unknown: uncultivated organism with predicted taxonomy: Bacteroides sp. CAG:770
  REGION 1..1191: note = MG16-50 effector
ILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKCFQEIKDEGLTIGQHFAVKLKESEVITDKGAFYNYRIKEQVFPRAAYVEEFDRIIQCQREFYPDVFTEAIVNEIRNEIIYYQRPLKSCKHLVSVCEFMQRELFDAGHNPIRHRKGEIVVAGPKCAPKSSPLAQVCKIWEEVNNIRITNKENDEYFISIDNKHEIFDFLNTHEKMKADDLFKILGIAKNSGWSADRAMSKGMVGNTTRVALMKALKGRRDIDDILRFDLREVESNQVNADTGEVLMEISAECESEPLYRLWHIIYSISDKNEQKSALKNQFGISDDSMLESLCKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNAKTAIGEEQISLDKWTLAQAHFSVADVADHVADILVSFKSGKKVTTPGKRYVYRAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKHVREVVTARLAAFGDEPKKAFAEPLYADVAGKIQIKTVRCYTGLSQVVPVKKDADGNDIGFVKPGNNHHIAIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 1138 - protein, 1220 aa, unidentified; identical to SEQ ID NO: 1136
  REGION 1..1220: note = Description of Unknown: uncultivated organism with predicted taxonomy: Bacteroides sp. CAG:770
  REGION 1..1220: note = MG16-51 effector

SEQ ID NO: 1139 - protein, 1217 aa, unidentified
  REGION 1..1217: note = Description of Unknown: uncultivated organism with predicted taxonomy: Bacteroides sp. CAG:770
  REGION 1..1217: note = MG16-52 effector
MKKILGLDLGVGSVGWSVVSCDDEHKPVEILGMGSRIVPLTPDESNEFSSGNAASKNQSRTQKRTARKGYDRYQLRRQALTVKLRELGMLPDETLIKLPVLDLWTLRARAATPGDKLSLPEIGRVLYHLNQKRGYRHSKQDDSADKTQRDYVQAVNKRFQEIKDEGLTIGQHFAVKLKESELITDKGAFYNYRIKEQVFPRAAYVEEFDRIIQCQREFYPEVFTEAIVNEIRNEIIYYQRPLKSCKHLVSVCEFMQRELFDAGHNPIRNRKGEIVVAGPKCAPKSSPLAQVCKIWEEINNIRVTNKENDEYFISIDNKHEIFDFLNTHEKMKADDLFKILGIAKNSGWSADRAMSKGMVGNTTRVALMKALKGRRDIDDILRFDLREVESNQVNADTGEVLMEIGAECESEPLYRLWHIIYSISDKNEQKAALEKQFGITDKSMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRIVAQENILVPRGALSEESVYGRIKSIEEKVPVKKLFERVDDIVKPRIRRLIRDRLKACGGDCSKAVSSLKKSPLYLDEENTIMLEYGSCFKPEYVIKYSLNSIKAKDAVSIVDNHVREVVTERLAAFGDDPKKAFAEPLYADAAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1140 - protein, 1221 aa, unidentified
  REGION 1..1221: note = Description of Unknown: uncultivated organism with predicted taxonomy: Bacteroides sp. CAG:709
  REGION 1..1221: note = MG16-53 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRIQSFKALFALHPRKVAVSLLGEMSLKND

SEQ ID NO: 1141 - protein, 1221 aa, unidentified
  REGION 1..1221: note = Description of Unknown: uncultivated organism with predicted taxonomy: Bacteroides sp. CAG:709
  REGION 1..1221: note = MG16-54 effector
MKKILGLDLGVGSIGWSLINADKDNKPIAILGLGSRIISLSPDESSEFTSGNAASKNQKRTQKRTARKGYDRYQMRRSALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRIMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLMACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1142 - protein, 1220 aa, unidentified
  REGION 1..1220: note = Description of Unknown: uncultivated organism with predicted taxonomy: Bacteroides sp. CAG:770
  REGION 1..1220: note = MG16-55 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQRGFYPEVLTEANVNEIRNEIIYYQRPLKSCKHLVSVCEFMQRELFDADHNPIRNGKGEIVVAGPKCAPKSSPLAQVCKIWEEINNIRVTNKENDEYFISIDNKHEIFDFLNTHEKMKADDLFKILGLAKNSGWSADRAMSKGMVGNTTRVALMKALKGRRDIEEVLRFDLRAVESNQVNADTGEVLMEISAECEREPLYRLWHIIYSISDKNEQKSALKNQFGISDESMLESLYKIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSATEFLNGLDVEIEHVIPKSLLFDDSFSNKVCACRKCNAEKGNATAFDFMKGRGENAFEDYLKRVETAFKENRISQTKRSRLLTPADKIPKDFISRQLVQTQYISRKAMDILNQVCRNVYGSSGDVTAYLRRIWGYDEILHSLDLPRYREGNLTGDVTYVHRGQTHTEERIKDWSKRLDHRHHAIDALTIASTRQSIIQRLNTLNAKAAIGEEQMSLDKWTLAQAHFSVADVADHVADILVSFKSGKKVATPGKRYVYRAGSRNVAQENILVPRGALSEESVYGRIKSIEEKVPVKKLFERVDDIVKPRISHLICERLEACGGDCSKAVSSLKKSPLYLDEENTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEELARGLPSPEWTFVMSMQQNEMFVLGMGDDEFNDAMAGRDYKSLGEHLYRVQKLATSDYFFRSQYETKLDDTKNALSMKKYYRTRSFKALFALNPHKVSISLLGEISLKDD

SEQ ID NO: 1143 - protein, 1219 aa, unidentified
  REGION 1..1219: note = Description of Unknown: uncultivated organism with predicted taxonomy: Bacteroides sp. CAG:545
  REGION 1..1219: note = MG16-56 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMGKALGKEHNTKKSDLLRFDLRLKENGVNKDTGEIIYEIDPACENEPLYRLWHVIYSINDKDALRHALTNQFGINDGESLRKLTKIDFVKQGYGSRSAKFMRKLLPALMDGARYSEACDMIGINHSDSLTKSENEARELLHKIPQLQKNELRQPVVEKILNQMINVVNAVIEQFGSIDEIRVEMARKLKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPFEYGTCYKAEYVMRYALSALKPKDVEFIVDEHIRKVVSERLSEYGNDPKKAFAEPLYADKSKTIPIRALRCYTGLAQVVPVKKDSKGNDIGFVKPGNNHHIAIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 1144 - protein, 1220 aa, unidentified; identical to SEQ ID NO: 1108
  REGION 1..1220: note = Description of Unknown: uncultivated organism with predicted taxonomy: Bacteroides sp. CAG:770
  REGION 1..1220: note = MG16-57 effector

SEQ ID NO: 1145 - protein, 1223 aa, unidentified
  REGION 1..1223: note = Description of Unknown: uncultivated organism with predicted taxonomy: Bacteroides sp. CAG:770
  REGION 1..1223: note = MG16-58 effector
MKKILGLDLGVGSVGWSVISCDDEHRPREILGMGSRIVPLTPDESNEFSSGNAASKNQSRTQKRTARKGYDRYQSRRKALTDKLRELDMLPDEALIKLPVLDLWTLRARAATPGDKLSLPEIGRVLYHLNQKRGYRHSKQDDSADKTQRDYVQAVNKRFQEIKDEGLTIGQHFAEKLKDSEIITDKGAFYNYRIKEQVFPRAAYVEEFDRIIQCQREFYPEVLTEANVNEIRNEIIYYQRPLKSCKHLVSVCDFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKTGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVTVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1146 - protein, 1221 aa, unidentified
  REGION 1..1221: note = Description of Unknown: uncultivated organism with predicted taxonomy: Bacteroides sp. CAG:770
  REGION 1..1221: note = MG16-59 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISLEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNNTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLEHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVMCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIYYVFRHQYETQLDDSKGAQIMKKFYRAQSFKALFALHQRKVSVSLLGEMALKDD

SEQ ID NO: 1147 - protein, 1221 aa, unidentified
  REGION 1..1221: note = Description of Unknown: uncultivated organism with predicted taxonomy: Bacteroides sp. CAG:770
  REGION 1..1221: note = MG16-60 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGSNHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYFVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNISEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1148 - protein, 1221 aa, unidentified
  REGION 1..1221: note = Description of Unknown: uncultivated organism with predicted taxonomy: Bacteroides sp. CAG:709
  REGION 1..1221: note = MG16-61 effector
MKKILGLDLGVGSIGWSLINADKDNKPIAILGLGSRIISLSPDESSEFTSGNAASKNQKRTQKRTTRKGYDRYQMRRQALTDKLSKLKMLPDEHLIKLPVLDLWTLRARAATPGEKLTLQEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRDLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLEVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFIFGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1149 - protein, 1221 aa, unidentified
  REGION 1..1221: note = Description of Unknown: uncultivated organism with predicted taxonomy: Bacteroides sp. CAG:770
  REGION 1..1221: note = MG16-62 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKLGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1150 - protein, 1221 aa, unidentified
  REGION 1..1221: note = Description of Unknown: uncultivated organism with predicted taxonomy: Bacteroides sp. CAG:770
  REGION 1..1221: note = MG16-63 effector
MKKVLGLDLGVGSVGWSLVNVDDNYKPTEILGIGSRIISLSPDESSEFTSGNAASKNQKRRQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKGALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1151 - protein, 1219 aa, unidentified
  REGION 1..1219: note = Description of Unknown: uncultivated organism with predicted taxonomy: Alistipes sp. CAG:514
  REGION 1..1219: note = MG16-64 effector
MKKVLGLDLGVGSVGWSLVNVDDNYKPAEILGLGSRIISLSPDESSEFTSGNAASKNQKRTQKRTARKGYDRYQMRRQALTEKLRELKMLPDERLIKLPVLDLWTLRARAATPGEKLTLPEIGRVLYHINQKRGYRHSKSDDSADKEQRDYVQTVNKRFQEIKDEGTTIGQHFAIILKESEVFTEKGPFYNYRIKEQVFPRDAYIEEFDRIMACQKAFYPEELSDININEIRNEIIFYQRNLRSCKHLVSRCEFMTRRFFDAEHKPILNNSGEIVISGPKVAPKSSPIFQACKIWEEINNLSLRNKENDELHISREQKKEIFEYLDNNEKITATALYKILGIGKGDGWSMDKALSKGVTGNTTKTAIARALGKMNNPAKESLLRFDLRLKENGVNKDSGEVIYEIDPKCENEPLYRLWHIIYSINDKEALRQALTNQFGINDEESLKELSNIDFVKQGYGSRSAKFMRKLLPALIGGAKYSEACDMIGINHSGSLTKSENEARELLHKIPQLQKNELRQPVVEKILNQMINVVNAVIDQFGDIDEIRVEMARELKLSKEGRAATAKNIRDREKQNNEIAEKIKELGITPSKNKILKYRLWQESGQKCFYCGQPVGAAEFLNGLDVEIEHIVPKALLFDDSFSNKVCACRRCNAEKSNLTAYDYMKSKGENEFNDYLRRVDAAFNDHKISFTKRSRLLTPADKLPKDFILRQLVQTQYISRKAMEILKQVCHNVYGSSGEVTSYLRRIWGYDEILHSLDLPRYREGGMTTEVSYEHRGQTHTEERIKDWSKRLDHRHHAIDALTIACTRQSIIQRLNNLSSMTATAGESMSLDKWTSAQPHFSVQEVSDNVSRILVSFKAGKKVTTPGKRYIHRGGKRILTQEGLLIPRGALCEESVYGRILSLEKAVPVKKLFERVEDIVKPGIRAMVEERLQACNNDVKVACASLKKEPLYLDAEKTIPLEYGTCYKAEYVMKYTLSALKPKDVEYIVDEHIRKVVSERLSEYGNDPKKAFAEPLYADEAKTIPIRTVRCYTDLRQVAPVKKDANGNDIGFVKPGNNHHIAIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 1152 - protein, 1220 aa, unidentified
  REGION 1..1220: note = Description of Unknown: uncultivated organism with predicted taxonomy: Bacteroides sp. CAG:770
  REGION 1..1220: note = MG16-65 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDAGGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1153 - protein, 1221 aa, unidentified
  REGION 1..1221: note = Description of Unknown: uncultivated organism with predicted taxonomy: Bacteroides sp. CAG:770
  REGION 1..1221: note = MG16-66 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNAHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGEYMSLDKWTLAQPHFSVQEVSDNVSRILVSFKAGKKVTTPGKRYVYRGGKRILAQEGLLIPRGALCEESVYGRIHSLEKEVPVKKLFERVDDIVRPGIRAAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRNVEGTYHESIVTFWDSVERKKYGLPVIIRKPGEIWDILIDKNIPEELAAGLPAPDWQFVMSMQQNEMFVLGMEDDEFRDAMEVKNYKTLGAHLYRVQKLASIDYYFRSQYETALDNSAGARMMKKFYRINSIKSLFALHPRKVSVSLLGEMALKDD

SEQ ID NO: 1154 - protein, 1221 aa, unidentified
  REGION 1..1221: note = Description of Unknown: uncultivated organism with predicted taxonomy: Bacteroides sp. CAG:545
  REGION 1..1221: note = MG16-67 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEGNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPACENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAERTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1155 - protein, 1221 aa, unidentified; identical to SEQ ID NO: 1109
  REGION 1..1221: note = Description of Unknown: uncultivated organism with predicted taxonomy: Bacteroides sp. CAG:770
  REGION 1..1221: note = MG16-68 effector

SEQ ID NO: 1156 - protein, 1221 aa, unidentified; identical to SEQ ID NO: 1120
  REGION 1..1221: note = Description of Unknown: uncultivated organism with predicted taxonomy: Bacteroides sp. CAG:709
  REGION 1..1221: note = MG16-69 effector

SEQ ID NO: 1157 - protein, 1221 aa, unidentified
  REGION 1..1221: note = Description of Unknown: uncultivated organism with predicted taxonomy: Bacteroides sp. CAG:770
  REGION 1..1221: note = MG16-70 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKVLSKGFTGNTTKGAIAKALGKDHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGVNHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYDTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALNDD

SEQ ID NO: 1158 - protein, 1219 aa, unidentified; identical to SEQ ID NO: 1117
  REGION 1..1219: note = Description of Unknown: uncultivated organism with predicted taxonomy: Bacteroides sp. CAG:545
  REGION 1..1219: note = MG16-72 effector

SEQ ID NO: 1159 - protein, 1221 aa, unidentified
  REGION 1..1221: note = Description of Unknown: uncultivated organism with predicted taxonomy: Bacteroides sp. CAG:545
  REGION 1..1221: note = MG16-73 effector
MKKVLCLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEVGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLSLKENGVNKDTGEIIYEIDPACENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWQFVMSMQQNEMFVLGMKDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1160 - protein, 1220 aa, unidentified
  REGION 1..1220: note = Description of Unknown: uncultivated organism with predicted taxonomy: Bacteroides sp. CAG:770
  REGION 1..1220: note = MG16-74 effector
MKKILGLDLGVGSVGWSVISCDDEHRPLEILGMGSRIVPLTPDESNEFSSGNAASKNQSRTQKRTARKGYDRYQSRRKALTDKLRDLDMLPDETLIKLPVLDLWTLRARAATPGDKLSLPEIGRGLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEKVNNIRITNKENDEYFISIDNKHEIFDFLNTHEKMKADDLFKILGIAKNSSWSADRAMSKGMVGNTTRVALMKALKGRRDIDEILRFDLREVESSQVNADTGEVLMEISAECEREPLYRLWHIIYSISDKNEQKSALKNQFGISDDSMLESLCKIDFVKQGYSSRSFKFMRRILPSLMDGAKYSEACDVIGINHSDSITKAENQARELLTRLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSATEFLNGLDVEIEHIVPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHRGQTHTEERIRDWSKRLDHRHHAIDALTIASTRQSIIQRLNTLNANTAIGEEQISLDKWTLAQAHFSVADVADHVADILVSFKSGKKVATPGKRYVYRAGRRIVAQENILVPRGALSEESVYGRIKSIEEKVPVKKLFERADDIVKPRIRHLIGARLEACGGDCSKAVSSLRKSPLYLDEEKTIMLEYGSCFKPEYVIKYSLNSIKAKDAVSIVDNHVREVVTARLAAFGDDPKKAFAEPLYADEAGKIQIKTVRCYTGLSQVVPVKKDADGNDIGFVKPGNNHHIAIYKNADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 1161 - protein, 1221 aa, unidentified; identical to SEQ ID NO: 1119
  REGION 1..1221: note = Description of Unknown: uncultivated organism with predicted taxonomy: Bacteroides sp. CAG:709
  REGION 1..1221: note = MG16-75 effector

SEQ ID NO: 1162 - protein, 1219 aa, unidentified
  REGION 1..1219: note = Description of Unknown: uncultivated organism with predicted taxonomy: Bacteroides
  REGION 1..1219: note = MG16-76 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1163 - protein, 1220 aa, unidentified
  REGION 1..1220: note = Description of Unknown: uncultivated organism with predicted taxonomy: Bacteroides sp. CAG:770
  REGION 1..1220: note = MG16-77 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDFADKTQRDYVQAVNKRFQEIKNEGLTIGQHFAVKLKESEVITDNGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDSAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKRVTTPGKRYVYKAGRRIVVQENILVPRGALSEESVYGRIKSIEEKVPVKKLFERVDDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDALAGRDYKSLGEHLYRVQKLASLYYVFRSQYETKLDDSKGALTMKKFYRTASFKALFSLNPRKVSISLLGEISLKDD

SEQ ID NO: 1164 - protein, 1221 aa, unidentified
  REGION 1..1221: note = Description of Unknown: uncultivated organism with predicted taxonomy: Bacteroides
  REGION 1..1221: note = MG16-78 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSLLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRSVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1165 - protein, 1221 aa, unidentified
  REGION 1..1221: note = Description of Unknown: uncultivated organism with predicted taxonomy: Bacteroides sp. CAG:770
  REGION 1..1221: note = MG16-79 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHRISFIKRSRLLTPADKLPKDFISRQLIQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 1166 - protein, 1221 aa, unidentified; identical to SEQ ID NO: 1134
  REGION 1..1221: note = Description of Unknown: uncultivated organism with predicted taxonomy: Bacteroides sp. CAG:545
  REGION 1..1221: note = MG16-80 effector

SEQ ID NO: 1167 - protein, 1221 aa, unidentified
  REGION 1..1221: note = Description of Unknown: uncultivated organism with predicted taxonomy: Bacteroides
  REGION 1..1221: note = MG16-81 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDVILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADKSKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1168 - protein, 1221 aa, unidentified
  REGION 1..1221: note = Description of Unknown: uncultivated organism with predicted taxonomy: Bacteroides sp. CAG:770
  REGION 1..1221: note = MG16-82 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKRDIFEYLDNNEKINATALYKILDIGKCDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKLLKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGSKRILAQEGLLIPRGALCEESVYGRINSLEKGVPVKKLFERVDDIVKPGIRTAVEERLRACDNDVKVACASLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQKLTSIYYVFRHQYETQLDDSKGAQIMKKFYRAQSFKALFALHPRKVSVSLLGEMALKDD

SEQ ID NO: 1169 - protein, 1221 aa, unidentified
  REGION 1..1221: note = Description of Unknown: uncultivated organism with predicted taxonomy: Bacteroides sp. CAG:545
  REGION 1..1221: note = MG16-83 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGDSLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIDYYFRSQYETALDNSAGARMMKKFYRINSIKSLFTLHPRKVSVSLLGEMALKDD

SEQ ID NO: 1170 - protein, 1165 aa, unidentified
  REGION 1..1165: note = Description of Unknown: uncultivated organism with predicted taxonomy: Bacteroidetes
  REGION 1..1165: note = MG16-84 effector
MQTRKILGLDLGVGSVGWALIETEDDQPKSILAMGSRIVPLSSDDSTKFQKGQAITKNAERTQKRTMRKGLNRYQIRRALLTDLLRRNGMLPEYMNENVIDLWQLRSDAATEGKQLSLPQIGRVLYHINQKRGYKHSKADISADAKQTKYVEAVNQRYRNIQALHQTIGQYFCQQLKETAVQTEKGVYYTFRIKEKVLPRASYVAEFDQIMKVQQSYYPNVLTDELIDTLRNHIIFYQRPLKSCKHLVGLCEFEMRPYKRNDGQIVYGGPKCAPRTSPLAQLCAVWEAVNNITLTNRSNETLEITPKQRKAMADFLYEHEKMGVKDLQKILGISPKDGWWAGKAIGKGIKGNTTYTQLRDALGPISNAADLLSMKIELTDSMVDTTTAELIRQVSPNVEEQPLYRLWHIVYSAQNEDDLRKALHKQFDIEDEKVVANLGKIDFVKPGYANKSNKFMRKLLPYLMQGYKYNEACAHIGVNHSNSLTAEQNTVRPLLDKIPLLEKNALRQPVIEKILNQMINVVNALKAEFGDIDDVRIELARELKESKDERESAFKRNNENERKNKEYEARIREYGIRPSRSRIQKYKMWEESQKKCFYCGKTIDVVEFLNGVDAEIEHIIPQSVLFDDSFSNKVCSCRDCNHTKGNLTAREFMEQHSAADYEAYLRRVDEAFDEHRISKTKRDHLLWRKEDIPQDFIDRQLRQSQYIAKKAAEILRQGVRNVYATSGSVTDFLRHQWGYDNILHYLNLPRYQQVDGLTESVTYDHCGQKHQEERIKDWTKRLDHRHHAIDALTIALTQQSVIQRLNTLNASREEMKNDLGQRIDTPEYTEKRSLLEKWVDIQPHFSVQEVTDKVDGILISFRAGKRVATPAKRAIYQQRKRCIVQTGLQVPRGALSEETVYGKLGNKYVVKYALTHPSMKVDDIVDPTIREIVRNRLNAFGGNVKDAFAESLYSDVAHKMQIKSVRCYTNLQDKAVSAVRFNAQGEPVGFVKMGNNHHIAIYCDKKGQYQESVVSFWHAVERKRYGIPVVIEKPQEVWDKLIDIDAIPQDFLENLPKDDWQFVVSLQQNEMFILGMDEADYEAAMEQKDYRTLNKYLYRVQKISSKEYYFRYHTETSVDDKYEGKNNPNISIELQKLKRIKSFGALFSQHPHKVRINLLGEISAL

SEQ ID NO: 1171 - protein, 1221 aa, unidentified
  REGION 1..1221: note = Description of Unknown: uncultivated organism with predicted taxonomy: Bacteroides
  REGION 1..1221: note = MG16-85 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKGYKTLGAHLYRVQNISSLYYVLRLQYETQVDNSNEALNMKKFHRIRSFNALFALRPRKVSVSLLGEMALKDD

SEQ ID NO: 1172 - protein, 1221 aa, unidentified
  REGION 1..1221: note = Description of Unknown: uncultivated organism with predicted taxonomy: Bacteroides sp. CAG:545
  REGION 1..1221: note = MG16-86 effector
MKKVLGLDLGVGSVGWSLVNVDDNYKPTEILGIGSRIISLSPDESSEFTSGNAASKNQKRTQKRTARKGYDRYQMRRQALTEKLRELKMLPDEHLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHIRPEQKKDIFEYLDNNEKINATTLYKILDIGKGDGWSVDKALSKGFTGNTTKVAIAKVLGKEHNTKKSDLLRFDLRLKENGVNKDTGEIIYEIDPTCENEPLYRLWHVIYSINDKDALRQALTNQFGINDGESLRELTKIDFVKQGYGSRSAKFMRKLLPALMDGARYSEACDMIGINHSGSLTKSENEARELLHTIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPANKLPKDFISRQLVQTQYISRKAMEILKQVCHNVYGSSGEVTSYLRRIWGYDEILHSLDLPRYREGGMTAEVSYDHLGQTHTEERIKDWSKRLDHRHHAIDALTIACTRQSIIQRLNNLSAMSAVAGESMSLDKWTLAQPHFSVQEVSDNVSRILVSFKAGKKVATPGKRYVYRGGKRILAQEGLLIPRGALCEESVYGRINSLEKGVPVKKLFERVDDIVKPGIRTAVEERLRACDNDVKVACVSLKKEPLYLDVEKTIPLEYGTCYKAEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYLRSQYETTLDDSAGARMMKKFYRIKSIKSLFALHPRKVSVSLLGEMALKDD

SEQ ID NO: 1173 - protein, 1221 aa, unidentified; identical to SEQ ID NO: 1172
  REGION 1..1221: note = Description of Unknown: uncultivated organism with predicted taxonomy: Bacteroides
  REGION 1..1221: note = MG16-87 effector

SEQ ID NO: 1174 - protein, 1219 aa, unidentified
  REGION 1..1219: note = Description of Unknown: uncultivated organism with predicted taxonomy: Bacteroides
  REGION 1..1219: note = MG16-88 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIADKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDNVSQILVSFKAGKKVTTPGKRYVYRGGKRILAQKGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAIYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1175 - protein, 1221 aa, unidentified; identical to SEQ ID NO: 1118
  REGION 1..1221: note = Description of Unknown: uncultivated organism with predicted taxonomy: Bacteroides sp. CAG:709
  REGION 1..1221: note = MG16-89 effector

SEQ ID NO: 1176 - protein, 1223 aa, unidentified
  REGION 1..1223: note = Description of Unknown: uncultivated organism with predicted taxonomy: Bacteroides sp. CAG:770
  REGION 1..1223: note = MG16-90 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVLDLWTLRARAATPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQREFYPEVFTEAIVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVGSNQVNADTGEVLMEISAECEREPLYRLWHIIYSISDKNEQKSALKNQFGISDDSMLESLCKIDFVKQGYSSRSFKFMRKILPSLMDGAKYSEACDVIGINHSDSITKAENQARELLTRLPQLQKNELRQPVVEKILNQMINVVNAVIDKYGAIDEIRVEMARELKLSKAGRESAAKNIRTREKANEEIAKRIEELDLVPSKNKILKYRLWEESGKRCFYCGQPVSATEFLNGLDVEIEHIVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNTLNAKTAIGEEQMSLDKWTLAQAHFSVADVADHVAGILVSFKSGKRVTTPGKRYVYKAGRRIVAQENILVPRGALSEESVYGRIKSIEEKVPVKKLFERVDDIVKPRIRYLIRERLETFGGDCSKAVSSLKKSPLYLDEENTIMLEYGSCFKYSYVKKSKLIQLDKKDDFINVSLIVDKHIREVVTARLAAFGGDTKKAFAEPLYADEAGKIQIRTVRCYTNSTVVPVKKDADGNDIGFVKPGNNHHIAIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 1177 - protein, 1223 aa, unidentified; identical to SEQ ID NO: 1176
  REGION 1..1223: note = Description of Unknown: uncultivated organism with predicted taxonomy: Bacteroides sp. CAG:770
  REGION 1..1223: note = MG16-91 effector

SEQ ID NO: 1178 - protein, 1219 aa, unidentified; identical to SEQ ID NO: 1151
  REGION 1..1219: note = Description of Unknown: uncultivated organism with predicted taxonomy: Alistipes sp. CAG:514
  REGION 1..1219: note = MG16-92 effector

SEQ ID NO: 1179 - protein, 1219 aa, unidentified; identical to SEQ ID NO: 1151
  REGION 1..1219: note = Description of Unknown: uncultivated organism with predicted taxonomy: Alistipes sp. CAG:514
  REGION 1..1219: note = MG16-93 effector

SEQ ID NO: 1180 - protein, 1221 aa, unidentified
  REGION 1..1221: note = Description of Unknown: uncultivated organism with predicted taxonomy: Bacteroides sp. CAG:545
  REGION 1..1221: note = MG16-94 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSYNVSRILVSFKAGKKVTTPGKRYVYRGGKRILAQEGLLIPRGALCEESVYGRIHSLEKEVPVKKLFERVDDIVKPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDPKGNDIGFVKPGNNHHIAIYRDAEGTYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETALDNSAGARMMKKFYRINSIKSLFALHPRKVSVSLLGEMALKDD

SEQ ID NO: 1181 - protein, 1221 aa, unidentified
  REGION 1..1221: note = Description of Unknown: uncultivated organism with predicted taxonomy: Bacteroides sp. CAG:709
  REGION 1..1221: note = MG16-95 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENCVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQIHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1182 - protein, 1189 aa, unidentified
  REGION 1..1189: note = Description of Unknown: uncultivated organism with predicted taxonomy: Bacteroides
  REGION 1..1189: note = MG16-96 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKISQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKMIPIRAVRCYTSLAQVAPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMK

SEQ ID NO: 1183 - protein, 1221 aa, unidentified
  REGION 1..1221: note = Description of Unknown: uncultivated organism with predicted taxonomy: Bacteroides
  REGION 1..1221: note = MG16-97 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPKELSEDNIDEIRNKIIFYQRDLKSCKHLVSQCEFMTRSFLDANHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFSSIDEIRVEMARELKLSKEGRAATAKNIRNREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGVLCEESVYGRIHSLEKEVPVKKLFERVDDIVKPGIRAAVEERLRAYDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKSGEIWDILIDKNIPEELAAGLPAPDWKFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1184 - protein, 1220 aa, unidentified
  REGION 1..1220: note = Description of Unknown: uncultivated organism with predicted taxonomy: Bacteroides sp. CAG:770
  REGION 1..1220: note = MG16-98 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVLDLWTLRARAATPGEKLSLAEIGRVLYHLNQKRGYRHSKEDDSADKTQRDYVQAVNKRFQEIKDEGLTIGQHFAVKLKESEVITDKGAFYNYRIKEQVFPRAAYVEEFDRIIQCQREFYPEVFTEAIVNEIRNEIIYYQRPLKSCKHLVSVCEFMQRELFDAEQNPIRNRKGEIVVAGPKCAPKSSPLAQVCKIWEEINNIRVTNKENDEYFISIDNKHEIFDFLNTHEKMKADDLFKILGIAKNSGWSADKAMSKGMVGNTTRVALMKALKGRRDIDEILRFDLREVESNQVNADTGEVLMEIGAECESEPLYRLWHIIYSISDKNEQKAALEKLFGITDESMLESLCRIDFVKQGYSGRSFKFMRKILPSLMDGAKYSEACDVIGINHSDSITKAENQTRKLLTKLPQLQKNELRQPVVEKILNQMINVVNAVIGKYGAIDEIRVEMARELKLSKEGRESAAKNIRAREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKSGRRIVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKTKDAASIVDKHIREVVTARLAAFGDDPKKAFAEPLYADEAGKIQIKTVRCYTGLCQVVPVKKDAAGNDIGFVKPGNNHHIAIYKDADGKYQESIVTFCDAVERKKYGIPVVVRNPAAVLDTIIDKNVPEDLAGGLPSPEWTFVMSMQQNEMFVLGMGDDEFNDAMAGMDYKSLGEHLYRVQKLATSDYFFRSQYETKLDDTKNALSMKKYYRTRSFKALFALNPHKVSISLLGEISLKDD

SEQ ID NO: 1185 - protein, 1219 aa, unidentified
  REGION 1..1219: note = Description of Unknown: uncultivated organism with predicted taxonomy: Bacteroides sp. CAG:709
  REGION 1..1219: note = MG16-99 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQSHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRDSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDRLKACDNDVNAACASLKKEPLYLDAEKTIPLEYGTCYKAEYVMKYALSALKPKDVEYIVDEHIRKVVSERLSEYGNDPKKAFAEPLYADKSKTIPIRAARCYTDLRQVAPVKKDANGNNIGFVKPGNNHHIAFYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 1186 - protein, 1221 aa, unidentified
  REGION 1..1221: note = Description of Unknown: uncultivated organism with predicted taxonomy: Bacteroides sp. CAG:709
  REGION 1..1221: note = MG16-100 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKVVISGPKVAPKSSPIFQVCKIWEEINNLSIRNKENDELHISPEQKKEIFEYLDNNEKITSAALYKILGIGKGDGWSVDKALSKGFTGNTTKVAISKSLGKANDAKKRDLMRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACNVIGVNHSGSLTKSENEARELLQRIPQLQKNELRQPVVEKILNQMINVVNAVIEKFGGVDEIRVEMARELKLSKEGRAATAKNIRDREKENKEIAEKIIELDVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILSMEDDEFRDAMAEADYKALGAHLYRVQKLTGSDYYFRSHYETLLDDSAGARIMKKFYRVRSFNALFNLHPRKVSVSLLGEMALKDD

SEQ ID NO: 1187 - protein, 1221 aa, unidentified
  REGION 1..1221: note = Description of Unknown: uncultivated organism with predicted taxonomy: Bacteroides sp. CAG:545
  REGION 1..1221: note = MG16-101 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLSEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEETNNLSIRNKENDELHISPEQKKDIFEYLDNNEKINATALYKILGIGKGDGWSVDKALSKGFTGNTTKVAMAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTSEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKDVPVKKLFERVDDIVKPGIRAAVEERLRACDNDVKVACASLKKEPLYMDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 1188 - protein, 1220 aa, unidentified
  REGION 1..1220: note = Description of Unknown: uncultivated organism with predicted taxonomy: Bacteroides sp. CAG:770
  REGION 1..1220: note = MG16-102 effector
MKKILGLDLGVGSVGWSVVSCDDEHKPVEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKQDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDDILRFDLREVESNQVNSDTGEVLMEISAECESEPLYRLWHIIYSISDKNEQKAALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYCSSGDVTAYLRRIWGYDEILHSLDLPRYREGNLTGDVTYVHMGQTHTEERIKDWSKRMDHRHHAIDALTIACTRQSIIQRLNTLNAKTAIGEEQMSLDKWTLAQAHFSVADVADHVADILVSFKSGKRVTTLGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDVASIVDKYIREVVTARLAAFGDDPKKAFAEPLYADEAGKIQIKTVRCYTGLSQVVPVKKDADGNDIGFVKPGNNHHIAIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 1189 - protein, 1220 aa, unidentified
  REGION 1..1220: note = Description of Unknown: uncultivated organism with predicted taxonomy: Bacteroides sp. CAG:770
  REGION 1..1220: note = MG16-103 effector
MKKILGLDLGVGSVGWSVVSCDDEHKPVEILGMGSRIVPLTPDESNEFSSGNAASKNQSRTQKRTARKGYDRYQSRRKALTDKLRELDMLPDETLIKLPVLDLWTLRARASTPGDKLSLPEIGRVLYHLNQKRGYRHSKQDDSADKTQRDYVQAVNKRFQEIKDEGLTIGQHFAEKLKESEIITDKGAFYNYRIKEQVFPRAAYVEEFDRIIQCQRKFYPEVLTEANVNEIRNEIIYYQRPLKSCKHLVSVCEFMQRELFDADHNPIRNGKGKIVVAGPKCAPKSSPLAQVCKIWEEVNNIRITNKENDEYFISIDNKHEIFDFLNTHEKMKADDLFKILGIAKNSGWSADKAMSKGMVGNTTRVALMKALKGRRDIDDILRFDLREVESNQVNADTGEVLMEIGAECESEPLYRLWHIIYSISDKNEQKSALEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKSGRESAAKNIRTREKANEEIAKRIEELGLVPSKNKILKYRLWEESGKRCFYCGQPVSATEFLNGLDVEIEHVVPKSLLFDNSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHYLDLPRYREGNLTGDVTYVHRGQTHTEERIRDWSKRLDHRHHAIDALTIACTRQSIIQRLNTLNAKTAIGEEQMSLDKWTLAQAHFSVADVADHVADILVSFKSGKKVTTPGKRYVYKAGRRNVAQKNILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKAKDAVSIVDNHIREVVTARLAAFGDDPKKSFAEPLYADEAGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 1190 - protein, 1221 aa, unidentified; identical to SEQ ID NO: 1119
  REGION 1..1221: note = Description of Unknown: uncultivated organism with predicted taxonomy: Bacteroides
  REGION 1..1221: note = MG16-104 effector

SEQ ID NO: 1191 - protein, 1220 aa, unidentified
  REGION 1..1220: note = Description of Unknown: uncultivated organism with predicted taxonomy: Bacteroides sp. CAG:770
  REGION 1..1220: note = MG16-105 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQEIKNEGLTIGQHFAEKLKESEIITDKGSFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLYKIDFVKQGYSSRSFKFMRKILPSLMDGAKYSEACDVIGINHSDSITKAENQTRKLLTKLPQLQKNELRQPVVEKILNQMINVVNAVIDKYGAIDEIRVEMARELKLSKAGRESAANNIRTRKKVNEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFIARQLVQTQYISRKAMEILNQVCRNVYGSSGDVTAYLRRIWGYDEILHSLDLPRYREGNLTENVTYVHRGQTHTEERIKDWSKRLDHRHHAIDALTIACTRQSIIQRLNTLNAKTAIGEEQMSLDKWTLAQTHFSVADVADHVADILVSFKSGKRVTTPGKRYVYKAGRRRVAQENILVPRGALSEESVYGRIKSIEEKVPVKKLFERVDDIVKPRIRRLIRERLEACGGDCSKAVSSLKKSPLYLDEENTIMLEYGSCFKPEYVIKYSLNSIKAKDAVSIVDKHIREVVIARLAAFGDDPKKAFAEPLYADEAGKIQIKTVRCYTGLSQVVPVKKDADGNDIGFVKPGNNHHIAIYKDADGKYQESIVTFRDVVERKKYGIPVVVRNPAAVLDTIIDKNVPEDLAGGLPSPEWTFVMSMQQNEMFVLGMGDDEFNDAMSGMDYKSLGEHLYRVQKLASLYYVFRSQYETKLDDSKGALTMKKFYRTASFKALFALNPRKVSISLLGEISLKDD

SEQ ID NO: 1192 - protein, 1221 aa, unidentified
  REGION 1..1221: note = Description of Unknown: uncultivated organism with predicted taxonomy: Bacteroides sp. CAG:545
  REGION 1..1221: note = MG16-106 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVLPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTQKSDLLRFDLRLKENGVNKDTGEIIYEIDPTCENEPLYRLWHVIYSINDKDALRHALTNQFGINDGESLRELSKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLDKEVPVKKLFERIDDIVKPGIRTAVEERLRACDNDVKVACASLKKEPLYLDVEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYKDAEGTYHESIVTFWDSVERKKYGLPVIIRKPGEIWDIIIDKNIPEELAAGLPAPDWQFVMSMQQNEMFVLGMEDDGFRDAMEVKDYKTLGAHLYRVQKLTSIDYYFRSQYETTLDDSAGARMMKKFYRIKSIKSLFALHPRKVSVSLLGEMALKDD

SEQ ID NO: 1193 - protein, 1221 aa, unidentified
  REGION 1..1221: note = Description of Unknown: uncultivated organism with predicted taxonomy: Bacteroides sp. CAG:545
  REGION 1..1221: note = MG16-107 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEAREFLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1194 - protein, 1220 aa, unidentified; identical to SEQ ID NO: 1111
  REGION 1..1220: note = Description of Unknown: uncultivated organism with predicted taxonomy: Bacteroides sp. CAG:770
  REGION 1..1220: note = MG16-108 effector

SEQ ID NO: 1195 - protein, 1221 aa, unidentified
  REGION 1..1221: note = Description of Unknown: uncultivated organism with predicted taxonomy: Bacteroides sp. CAG:709
  REGION 1..1221: note = MG16-109 effector
MKKILGLDLGVGSIGWSLINADKDNKPIAILGLGSRIISLSPDESSEFTSGNAASKNQKRTQKRTARKGYDRYQMRRQSLTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRIHSLEKGVPVKKLFERVDDIVKPGIRAAVEERLRACDNDVKVACASLKKEPLYLDAEKTIPLEYGTCYKAEYVMKYALSALKPKDVEYIVDEHIRKVVSERLSEYGNDPKKAFAEPLYADDAKTIPIRAVRCYTGLAQVVPVKKDSKGNDIGFVKPGNNHHIAIYRDADGAYHENVVTFWDTVERKKYGLPVIIRKPGEIWDILIDKNIPEELAAGLPAPDWKFVMSMQQNEMFVLGMEDDEFRDAMEVKDYKTLGAHLYRVQKLASSYYVFRHQYETQLDDSKCAQIMKKFYRAQSFKALFALHPRKVSVSLLGEMALKDD

SEQ ID NO: 1196 - protein, 1221 aa, unidentified; identical to SEQ ID NO: 1195
  REGION 1..1221: note = Description of Unknown: uncultivated organism with predicted taxonomy: Bacteroides sp. CAG:709
  REGION 1..1221: note = MG16-110 effector

SEQ ID NO: 1197 - protein, 1221 aa, unidentified; identical to SEQ ID NO: 1150
  REGION 1..1221: note = Description of Unknown: uncultivated organism with predicted taxonomy: Bacteroides sp. CAG:770
  REGION 1..1221: note = MG16-113 effector

SEQ ID NO: 1198 - protein, 1221 aa, unidentified
  REGION 1..1221: note = Description of Unknown: uncultivated organism with predicted taxonomy: Bacteroides sp. CAG:545
  REGION 1..1221: note = MG16-114 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQESLLIPRGALCEESVYGRIHSLEKEVPVKKLFERVDDIVRPGIRAAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLACIYYVFRHQYETQLDDSKGAQIMKKFYRAQSFKALFALRQRKVSVSLLGEMALKDD

SEQ ID NO: 1199 - protein, 1221 aa, unidentified
  REGION 1..1221: note = Description of Unknown: uncultivated organism with predicted taxonomy: Bacteroides sp. CAG:770
  REGION 1..1221: note = MG16-115 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKKSEIVTDKGPFYNYRIKEQVFPRDAYIEEFDRIMDCQKTFYSEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1200 - protein, 1221 aa, unidentified
  REGION 1..1221: note = Description of Unknown: uncultivated organism with predicted taxonomy: Bacteroides
  REGION 1..1221: note = MG16-116 effector
MKKVLGLDLGVGSVGWSLVNVDDNYKPTEILGIGSRIISLSPDESSEFTSGNAASKNQKRTQKRTTRKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKAEYVMRYALSALKPKDVEFIVDEHIRKVVSERLSEYGNDLKKAFAEPLYADKSKTIPIRAVRCYTGLAQVVPVKKDSKGNAIGFVKPGNNHHIAIYKDADGTYHENVVTFWDTVERKKYGLPVIIRKPGEIWDILIDKNIPEELAAGIPAPDWKFVMSMQQNEMFVLGMEDDEFRDTMEVKDYKTLGAHLYRVQKLTSIYYVFRHQYETQLDDSKGAQIMKKFYRAQSFKALFSLHPRKVSVSLLGEMALKDD

SEQ ID NO: 1201 - protein, 1220 aa, unidentified
  REGION 1..1220: note = Description of Unknown: uncultivated organism with predicted taxonomy: Bacteroides sp. CAG:770
  REGION 1..1220: note = MG16-118 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSSKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVTTPGKRYVYKAGRRRVAQENILVPRGALSEESVYGRIKSIEEKVPVKKLFERVDDIVKPRIRHLVRERLEACGGDCSKAVSSLKKSPLYLDEENTIMLEYGSCFKPEYVIKYSLNSIKAKDAVSIVDKHVREVVTARLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISMLGEISLKDD

SEQ ID NO: 1202 - protein, 1221 aa, unidentified
  REGION 1..1221: note = Description of Unknown: uncultivated organism with predicted taxonomy: Bacteroides sp. CAG:709
  REGION 1..1221: note = MG16-119 effector
MKKILGLDLGVGSIGWSLINADKDNKPIAILGLGSRIISLSPDESSEFTSGNAASKNQKRTQKRTARKVYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVKAACTSLKEEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1203 - protein, 1221 aa, unidentified; identical to SEQ ID NO: 1135
  REGION 1..1221: note = Description of Unknown: uncultivated organism with predicted taxonomy: Bacteroides sp. CAG:709
  REGION 1..1221: note = MG16-120 effector

SEQ ID NO: 1204 - protein, 1223 aa, unidentified
  REGION 1..1223: note = Description of Unknown: uncultivated organism with predicted taxonomy: Bacteroides sp. CAG:770
  REGION 1..1223: note = MG16-121 effector
MKKILGLDLGVGSVGWSVISCDDEHRPLEIVGMGSRIVPLTPDESNEFSSGNAASKNQSRTQKRTARKGYDRYQSRRKALTDKLRELDMLPDETLIKLPVLDLWTLRARAATPGDKLSLPEIGRVLYHLNQKRGYRHSKQDDSADKTQRDYVQAVNKRFQDIKDEGLTIGQHFAEKLKESEIITDKGAFYNYRIKEQVFPRAAYVEEFDRIIQCQREFYPEVLTEANVNEIRNEIIYYQRPLKSCKHLVSVCEFMQRELFDADHNPIRNGKGKIVVAGPKCAPKSSPLARVCKIWEEINNIRVTNKENDEYFISIDNKHEIFDFLNTHEKMKADDLFKILGIAKNSGWSADRAMSKGMVGNTTRVALMKALKGRRDIDDILRFDLRDVESNQVNADTGEVLMEISAECESEPLYRLWHIIYSISDKNEQKSALKNQFGISDESMLESLCKIDFVKQGYSSRSFKFMRKILPSLMDGAKYSEACDVIGVNHSDSITKAENQARELLARLPQLQKNELRQPVVEKILNQMINVVNAVIDKYGAIDEIRVEMARELKLSKAGRESAAKNVRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGHGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYLHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRIVAQENILVPRGALSEESVYGRIKSIEEKVPVKKLFERVDDIVKPRIRHLIRERLEACGGDCSKAVSSLKKSPLYLDEENTIMLEYGSCFKYSYVKKSKLIQRDKKDDCINVSLIVDKHIREVVTARLAAFGGDTKKAFAEPLYADEAGKIQIKTVRCYTNSTVVPVKKDADGNDIGFVKPGNNHHIAIYKDADGKYQESIVTFRDAVERKKYGIPVVVRNPVEVMDTVIDKNVPEDLAGGLPSPEWTFVMSMQQNEMFVLGMGDDEFNDAMAGMDYKSLGEHLYRFQSISHADYYFRSQYETMLDNSKNAMAMKKYYRIRSFKALFALNPRKVSISLLGEISLKDD

SEQ ID NO: 1205 - protein, 1220 aa, unidentified
  REGION 1..1220: note = Description of Unknown: uncultivated organism with predicted taxonomy: Bacteroides sp. CAG:770
  REGION 1..1220: note = MG16-122 effector
MKKILGLDLGVGSVGWSVISCDDEHRPLEILGMGSRIVPLTPDESNEFSSGNAASKNQSRTQKRTARKGYDRYQLRRQALTVKLRELGMLPDEALIKLPVMDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDVIGVNHSDSITKAENQARELLTRLPQLQKNELRQPVVEKILNQMINVVNAVIDKYGAIDEIRVEMARELKLSKAGRESAAKNIRTREKANEEIAKRIEELGLVPSKNKILKYRLWEEFGKRCFYCGQPVSATEFLNGLDVEIEHVVPKSLLFDDSFSNKVCACRKCNAEKGNATAFDFMKGRGENAFEDYLKRVETAFKENRISQTKRNRLLTPADKIPKDFISRQLVQTQYISRKAMEILNQVCRNVYGSSGDVTAYLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRYLIRERLETCGGDCSKAVSSLKKSPLYLDEENTIMLEYGSCFKPEYVIKYSLNSIKAKDAVSIVDNHIREVVTARLAAFGDDPKKAFAEPLYADGAGKIQIRTVRCYTGLSQVVPVKKDADGNDIGFVKPGNNHHIAIYKDADGKYQESIVTFCDAVERKKYGIPVVVRNPVEALDTIIDKNVPEDLAGGLPSPEWTFVMSMQQNEMFVLGMGDDEFNDALAGMDYKSLGEHLYRVQKLATSDYFFRSQYETKLDDSKGASAMRKFFRTASLKALFALNPRKVSISLLGEISLKDD

SEQ ID NO: 1206 - protein, 1221 aa, unidentified
  REGION 1..1221: note = Description of Unknown: uncultivated organism with predicted taxonomy: Bacteroides sp. CAG:545
  REGION 1..1221: note = MG16-123 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDAEHKPILNSSGELVMSGPKVAPKSSPIFQACKIWEEINNLSIRNKENDELHISPEQKKDIFEYLDNNEKINATTLYKILGIGKGDGWSVDKALSKGFTGNTTKVAIAKVLGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIEQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLSPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYVLSALKPKDVEFIVDEHIRKVVSERLSEYGNDPKKAFAEPLYSDKSKTIPIRAVRCYTGLAQVVPVKKDSKGNAIGFVKPGNNHHIAIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRTNSIKSLFALHPRKVSVSLLGEMALKND

SEQ ID NO: 1207 - protein, 1221 aa, unidentified
  REGION 1..1221: note = Description of Unknown: uncultivated organism with predicted taxonomy: Bacteroides sp. CAG:770
  REGION 1..1221: note = MG16-126 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLDLWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSDELVISGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLCGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMAAVAGESMSLDKWTLAQPHFSVQEVSDNVSRILVSFKAGKKVTTPGKRYVYRGGKRILAQEGLLIPRGALCEESVYGRIHSLEKGVPVKKLFERVDDIVKPVIRAAVEERLRACDNDVKVACASLKKEPLYLDAEKTIPLEYGTCYKAEYVMKYALSALKPKDVEYIVDEHIRKVVSERLSEYGNDPKKAFAEPLYADKSKTIPIRAVRCYTGLAQVVPVKKDSKGNDIGFVKPGNNHHIAIYRDADGTYHENVVTFWDTVERKKYGLPVIIRKPGEIWDIIIDKNIPEELATCLPAPDWQFVMSMQQNEMFVLGMEDDEFRDAMEGKDYKTLGAHLYRVQKLTSIDYYFRSQYETTLDDSAGARMMKKFYRIKSIKSLFALHPRKVSVSLLGEMALKDD

SEQ ID NO: 1208 - protein, 1221 aa, unidentified
  REGION 1..1221: note = Description of Unknown: uncultivated organism with predicted taxonomy: Bacteroides sp. CAG:709
  REGION 1..1221: note = MG16-127 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNERITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSASLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKAYDNDVNAACASLKKEPLYLDAEKTIPLEYGTCYKREYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLAGSDYYFRSHYETLLDDSAGARIMKKFYRISSSKALFALHPRKVAVSLLGEMSLKND

SEQ ID NO: 1209 - protein, 1221 aa, unidentified
  REGION 1..1221: note = Description of Unknown: uncultivated organism with predicted taxonomy: Bacteroides sp. CAG:770
  REGION 1..1221: note = MG16-128 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 1210 - protein, 1221 aa, unidentified
  REGION 1..1221: note = Description of Unknown: uncultivated organism with predicted taxonomy: Bacteroides sp. CAG:709
  REGION 1..1221: note = MG16-129 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYREGKRILAQDGLLIPRGALSEESVYGRISALEKNVLVKKLFERVEDIVKPGIRAVVEDRLMACDNDVNAACASLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKRDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQSLSRSDYYYRCQYETQLDNSNGAMRMKKFYRVRSFNALFNLHPRKVAVSLLGEMSLKND

SEQ ID NO: 1211 - protein, 1220 aa, unidentified
  REGION 1..1220: note = Description of Unknown: uncultivated organism with predicted taxonomy: Bacteroides sp. CAG:770
  REGION 1..1220: note = MG16-130 effector
MKKILGLDLGVGSVGWSVISCDDEHRPLEILGMGSRIVPLTPEESNEFSSGNAASKNQSRTQKRTARKGYDRYQSRRKALTDKLRELDMLPDETLIKLPVLDLWTLRARAATPGDKLSLPEIGRVLYHLNQKRGYRYSKEDDSADKTQRDYVQAVNKRFQEIKNEGLTIGQHFAVKLKASEVITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEINNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEISAECEREPLYRLWHIIYSISDKNEQKSALKNQFGISDESMLESLCKIDFVKQGYSSRSFKFMRKILPSLMDGAKYSEACDVIGINHSDSITKAENQIRKLLTKLPQLQKNELRQPVVEKILNQMINVVNAVIDKYGAIDEIRVEMARELKLSKAGRESAANNIRTREKANEEIAKRIEELGLVPSKNKILKYRLWEESGKRCFYCGQPVSATEFLNGLDVEIEHVVPKSLLFDDSFSNKVCACRKCNAEKGNATAFDFMKGRGENAFEDYLKRVETAFKENKISQTKRNRLLTPADKIPKDFISRQLVQTQYISRKAMEILNQVCRNVYGSSGDVTAYLRRIWGYDEILHSLDLPRYRDGNLTEDVTYVHRGQTHTEERIKDWSKRLDHRHHAIDALTIACTRQSIIQRLNTLNAKTAIGEEQMSLDKWTLAQAHFSVADVADHVADILVSFKSGKKVTTPGKRYVYKAGRRRVAQENILVPRGALSEESVYGRIKSIEEKVPVKKLFERVDDIVKPRIRHLIRERLEACGGDCSKAVSSLKKSPLYLDEENTIMLEYGSCFKPEYVIKYSLNSIKTKDAASIVDKHVREVVTERLAAFGDDPKKAFAEPLYADEVGKIQIKTVRCYTGLSQVVPVKKDADGNDIGFVKPGNNHHIAIYKDADGKYQECIVTFRDAVERKKYGIPVVVRNPVEALDTIIDKNVPEDLAGGLPSPEWTFVMSMQQNEMFVLGMGEDEFNDAMAGMDYKSLGEHLYRVQKLASSDYFFRSQYETKLDDTKNALLMKKYYRTRSFKALFALNPHKVSISLLGEISLKDD

SEQ ID NO: 1212 - protein, 1221 aa, unidentified
  REGION 1..1221: note = Description of Unknown: uncultivated organism with predicted taxonomy: Bacteroides sp. CAG:709
  REGION 1..1221: note = MG16-131 effector
MKKILGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFVSRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSMQEVSDKVGGILVSFKAGKKVTTPGKRYTYRRGKRILAQDGLLIPRGALSEESVYGRISALEKNVLVKKLFERVEDIVKPGIRAVVEDRLKACDDDVKAACASLKKEPLYLDAEKTIPLEYGTCYKAKYVMKYALSALKPKDVEYIVDEHIRKVVSERLSEYGNDPKKAFAEPLYADDAKTIAVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1213 - protein, 1221 aa, unidentified
  REGION 1..1221: note = Description of Unknown: uncultivated organism with predicted taxonomy: Bacteroides
  REGION 1..1221: note = MG16-132 effector
MKKVLGLDLGVGSVGWSLVNVDDNYKPTEILGIGSRIISLSPDESSEFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTDKGPFYNYRIKEQVFPRDAYIEEFDRIMDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKGAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQKGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRALRCYTGLAQVVPVKKDSKGNAIGFVKPGNNHHIAIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1214 - protein, 1257 aa, unidentified
  REGION 1..1257: note = Description of Unknown: uncultivated organism with predicted taxonomy: Bacteroidales
  REGION 1..1257: note = MG16-133 effector
MKKILGLDLGTTSIGWALINAEDNNKPTEIQDIGVRIVPLAENEGDKFTKGQDITVNADRTRARGQRRNYDRFQLRRQALTEKLRSLDMLPDEHLIKLPVMELWQLRANAVTQKVSLNELGRVLYHLNQKRGYKHSRTDSNDSKQRAYVKEINNRYAELQKLGMTIGQYFAQKLEETAIKQNGKIFYAFRIKEQIYPRQAYEEEYDAIMKCQQTFYPEILTESIIEEIRNRIIYYQRDLRSCKHLVTVCEFEKRCFYDADGNVKRNQKGEIIYDGPKVVPRTSPLFQVFKNWQSINNIRFHNRKNEYLFITKEQKQQIANVMANQEVLKLKDVQEILGVTSKSGWYCDKAIKAGIKGNITKCAIIASLSSLPQSKIREITRFNLETETTNMVDEETGELLVRIKNTYQEEPLYKLWHIIYSIKNDNERLNTIISFLKDFDIEDISISNALNDLDFVTPGYANLSAKAISKILPYMMEGLDYSDSCEYVGYNHSDSLTKEENENRILLDKIPALKKNELRQPTVEKILNQTISIFNEINANLLQKGERVDEVRIELARELKQSKEEREKTDRGIRKQQKANEVFANLLKEQGVRPTRNRILKYRLWRESYETCFYCGQPISFKEFLKFSDVEREHVIPKRLLYDDSFANQVCSCRKCNAEKGGRTAIDYMRTTQHLQPYLEKVDKMFQEHKISGKKHAHLLASYDDYLSRKKEGKETKDDIIIWEEAIERQLRLSQYISKKAQELLKKSCREVIATSGSVTDLIRHTWGYDTILHELNLPCYKEAGLTTFIKEENTGQQKEVIKDWTKRLDHRHHAVDALTVACTSRSIIQHINTLHASREVMRGDVKTPRKEWENNDLLQQWIKEKMPFDRQYVLQKVASILVSMKSGKKSTVPGKRKIYIKGKPIVMQSGLRIPRGQLHEQTVYGAIKQYSKDKKGNLIEKKEIVTRYKMGVGSVGFVFNGKETCDVVFDKKNNRYVIADGIDKAINYIIDKHIRDIVRERLNEAFPDGETYRTEAEIALAAGKTYNGKERSMKALEQLKALYEQPLYADKNKHIVIKSVRCFTGLSAVQPLRYNDKNEPTSFVLTKNNHHVAIYLDEKGELKECIYTFWQAVERSKYKLPLIIKEPKSLWDEILERENNGEIFPDTLITSLPSPNWTFVESLQLNDMFVMDMDDVKFENFISSNNYEEIGKRIYRVQSLSSHDYVFRHHTDTTSSMMPEAALCRKFIRIKSLKAYIEHHPHKVQLSLLGKILTKR

SEQ ID NO: 1215 - protein, 1243 aa, unidentified
  REGION 1..1243: note = Description of Unknown: uncultivated organism
  REGION 1..1243: note = MG16-134 effector
MKKILGLDLGTNSIGWAVVNADENGNPVSIEGMGSRIVPLTADDTNEFTKGNAISKNQSRTEKRTARKGYDRYQLRRNKLTLEFRKLNMLPDEQLIKLQPLELWQLRATAATEGHKLTLPEIGRVLYHINQKRGYKHAKSDESADTKQKAYVAEVNARYAMIKERKQTIGQFFAEKLKENEIETSKGKLYTYRIKEQVFPRRAYEAEFDQIMECQRVFYPDVLTNEEINRLRNEIIFYQRKLKSCKHLVSLCEFEKREYKNKDGKIVIDGPKVAPKSSPLFQVCKIWEEINNITLRNRRNDELYISMDQRQAMFDFLDTHEKMTLSDLYSILGISKNDGWWGGKAIGKGLQGNTTKIALKNALGDFENADNLLQFKLESIDSNFVDEETGEIIQIINPNLEKEPLYDLWHTVYSISDKEELANALKKKFNINDEDIINNLYAIDFVKPGYGNKSAKAIRRILPYLQQGLKYSDACEYAGFRHSESLTKTENEQRQLLDKLPAIQKNALRQPIVEKILNQMINVVNALMVEYKEHFYSIRVELARELKQSKDDRNTTYLQNEAMERLNDAIAKRLNSEGIKTTKRILEKYKYIFPTKGCIDKKTGKFVSKNFENLSTVNQCIYCGKSFSLTAALNGDGYEVEHIIPRDLICDNSQSNKVLSCRSCNSKKSNKTAFDFMRGQGEQALEDYIARIEKWYKDGIISPAKREHLLLSHEDYLKRKKEGKTTDEDKKYWEDFVSRQAGETQYISREAIKILKQCCKNVNATSGAVTAILRHLWGYDEILHQLDFERYKKAGLTKIVTWESDHGKNKHTKEQIVNWTKRIDHRHHAIDALVIACTQQGFVQRINTLNADETKDLMKKQIESSGVKFEEKKDLLNKYLASLTPFSTQTVADNVDKILVSFKAGKKSASTGKRIKYVKGKKVVLQKGIIIPRGALHEEGVYGQIEINGKKEIVKKYKLGKGAQGFVFTGKETYEKKVNNKTGEIHVVDKIKNVLDSIVDVNIRSKILQRLNQGFEDGKDYRDDVKKALDNLNDLDKNPIFADDNNTIPIRTVRCRTGLSAVVPIKHNEKGEPIGFVKPGNNHHIAIYSDKNGNLHEHTVTFWHAVERKKYGIPVIIENPQSVWDSIIDKQLPESFLENLPDVKWTFEISLQQNEMFVLGMENESFEDAVRNNDFSTISKYLYRVQSISESDYWFRLHIETQNDKTPSAKLANKYHRVKSLKSFHELNPHKVYISVIGKIKAL

SEQ ID NO: 1216 - protein, 1078 aa, unidentified
  REGION 1..1078: note = Description of Unknown: uncultivated organism with predicted taxonomy: Porphyromonas sp. oral taxon 278
  REGION 1..1078: note = MG16-135 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKRKDKATDIDKKYWEDFVSRQAGETQYISREAIRILKQCCRYVNATSGSITATLRHLWGYDEILHQLNFERYKQAGLTKIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDDNPIFADKNNTIPIRTVRCRTGLSAVVPIKKNERGEAIGYVKP

SEQ ID NO: 1217 - protein, 1217 aa, unidentified
  REGION 1..1217: note = Description of Unknown: uncultivated organism with predicted taxonomy: Bacteroidales
  REGION 1..1217: note = MG16-136 effector
MRKILGLDLGVGSIGWSLIETDAEDNPKAILGMGSRIVPLSTDDANEFSSGNAISKNQKRTQKRTQRKGYDRYQLRRALLTQKLRELGMLPDERLIKLPVLELWQLRADAATPGKQLELKEIGRVLYHINQKRGYRHSRSDDGEDKSQKDYVQQVNQRYREILDEGTTIGQHFSKKLADNEVITPKGKFYTYRIKEQVFPRDAYVEEFDRIMECQRRFYPDLLTESTIREIRDEIVFFQRPLKSCKHLVSVCEFAMREYKTKEGKSILAGPKVAPRSSPLFQVCKIWESVNNLSLKNRSGEVYHFSQEERRKMFDFLDNHDKMAVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRQCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKMVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVIKYPVSSLKAKDVDSIVDRHIREIVRKRIDEVGEKEAFKTPIYTDDAQSIPLRSVRLFTGLDAVEPVKYVDGVPVGFSKPGNNHHIAIYRDQDGNRSEHVVSFWHAVERKRYGLPVIIRDTDSVWEQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPRKVRISVTGELIPIQ

SEQ ID NO: 1218 - protein, 1045 aa, unidentified
  REGION 1..1045: note = Description of Unknown: uncultivated organism with predicted taxonomy: Prevotella
  REGION 1..1045: note = MG16-137 effector
MKKILGLDLGTTSIGWALVNVDDNNNPVDIQDIGVRRVPLSENEGDKFTKGQDITVNADRTRARGTRRNYDRYQLRRQALTEKLRQLNMLPDENLIMLPIMDLWQLRADAVTKKVSLNELGRILYHLNQKRGYKHSRTDANDSKQREYVKEINNRYAKLLESKMTIGQLFANKLAETAVVQDGKIFYNYRIKDQIYPRNAYEEEYDAIMKCQQKFYPEILTDAIIDEIKNRIIYYQRDLRSCKHLVSICEFEKRCFYDEDGNVKRNKKGDIFYDGPKVAPRTSPLFQVFKDWQSINNLRFHNRRNEYLYITKEQKEQIADFMEHHEILKLKDVQSLLDITAKSGWYCDKAIKAGIKGNSTKCAILSSLSSLPHSKIAEITRFNLETETTNIVDEETGEMLVRIRNTYQNEPLYRLWHIIYSIKNDNERINAISKFLKEFEVEEETVINSLKDIDFVTPGYANLSAKAICKILPYMMEGLDYSDSCEYVGYNHSDSLTKEENEKRELLDKIPALKKNELRQPTVEKILNQTINVFNQINEDLSKDGERISEVRVELARELKQSKDERNETEIGIRKQQKLNDEYAKILKEEGVRPTRNRILKYRLWRESNKSCFYCEQPISFHEFLDFSETEREHIIPKKLMYDDSFANQVCSCRNCNKEKGGRTAMDYMRTKQNLQFYLDKVDKMFQDHKISGKKRSHLLASYDDYLFRKENGKETKDDILIWEKPIERQLRLSQYISRKAQELLRMTCRDVTVTTGEITALIRHTWGYDTILHDLNFSSYKEAGLTEIVKGEDSGRTREIIKDWSKRLDHRHHAIDALAVACTSRSIVQRINTLNASREEIRGEIKAPRKEWKDSNLLQQWIKEKMPFDRQYVLHKVASILISMKAGKKATVPGKRKIYKKGKPIVIQTGLRIPRGQLHEKTVYGAINQYDKGQKVMKIVTRYKMGVGSMGYVFNGKETCDVIKKKNRYEIVDGIQKALDYIVDKHIREIVKARMNEAFPEGETYLTEAEKALAEGKAYDGKARCQKALDQLRTLSERPLYADK

SEQ ID NO: 1219 - protein, 1217 aa, unidentified
  REGION 1..1217: note = Description of Unknown: uncultivated organism
  REGION 1..1217: note = MG16-138 effector
MKRILGLDLGVGSIGWSLIQADEDGNPQSIIDIGCRIVPLSPDDTNEFSSGNAISKNRKRAQKRSVRKGYDRYQLRRQNLTDELRGLGMLPDERLIKLPILALWQLRANAATPGKRLTLPEIGRIFYHINQKRGYLHSKSDEEDKNQRDYVQAINNRYATIKAEGKTIGQYFAQKLADSEVTTDKGKVYAFRIKEQVFPRQAYQEEFDQIIACQRIHYPEVLTDDVIHRLRDEIIFYQRPLKSCKHLVSLCEFAMREYKTTDGRSIQAGPKVTPRSSPLFQVCKIWESVNNIELKNRDGESYPFSAEERLKLFNFLDNNEKMTVTDLKRILGLGTKDKWWGGKAIGKGLQGNITKMALKKALPYHEELLSFNLKSIESRHIDTETGDILLEIAPDFEQEPLYRLWHIIYSMKDPDEMASALNRQFGIDDPTILTNLTRIDFVKAGYGNKSARFIRQILPYLQKGMKYSEACDYISINHSNSLTTAENNSRELLPHMQQLQKNELRQPVIEKILNQMVNVVNALLDKYGSIDEVRVELGRELKQSRDERNSAFLNNNKRERDNKAISERIQEMGIRASRSRILKYRLWEEAKHICFYCGQTVGVKEFLEGTDVEIEHIIPRSLFFDDSFSNKVCACRKCNAEKGNRTAYDYMKQKSDNDFADYTRRIEDAYEKKEISKTKRERLLTTAKDIPEDFIDRQLRQSQYISKKAVEMLKQVCRNVWTTSGSVTDFIRHQWGYDNILHDLNFKRYKDAGQTEIIISDHLGQVHQEERIKNWTKRLDHRHHAIDALTIASTKQSYIQRLNHLNSSRDKMFQELEAQSKEVKEKYSLLESWMRCRPHIPVSVVSQAIDGILVSFKTGKRITTPGKRFIYKSGKREVAQYGIAVPRGALSEESVYGSISCLEANVPVKKLFEHPEIIFKPYIREKVEKRINEFSGDWKAALKSLKKTPIFLRADGTEPLEYATCWKREYVIRYPLASLLKKDLPFIVDRNIRRLVSERINAVGEKDAFKEPLFADKADINPIRSVRLFTGLTQDSLSPVKYFNGYPIGYSKPGNNHHFCYYRNKNGELFEHIVSFWHAVDRKKYGIPVIIEDTDVLWEDMANRDLPQDFLKNLPPAGLKLEVSLQQNEMFVLGMPEEDFQNAIKENDQRALNKYLFRVQKISGQYNVFRRNTDTGKDEDSKAQSLGQFVRISSVRGWIHCCPHKVRISVLGEISEI

SEQ ID NO: 1220 - protein, 930 aa, unidentified
  REGION 1..930: note = Description of Unknown: uncultivated organism with predicted taxonomy: Bacteroidales
  REGION 1..930: note = MG16-139 effector
MKKKILGLDLGVGSIGWALIKTDDNQPKQIIGMGSRIVPISKDDNDQFSKGQAISKNADRTARRTTRKGYDRYQLRRALLTDVLRQNGMLPERMDEHVIDLWKLRSDAATEGHQLTLPQIGRVLYHINQKRGYKHAKADDNGDSKQTKYVEAVNQRYTDLQAEGLTIGQHFHLELLHSKVEGASGPYYTFRIKDKVFPRAAYIAEFDQIMRVQRVYYPEILTDELIDVLRNRIIFYQRPLKSCKHMVSLCEFEMRPYKTKDGRIVYGGPKCAPRTSPLAQFCAMWETANNITLTNRNNERYEFTLDARAQIVKHLCEHAVLKLTDLYKILGITKKDGWWGGKAIGKGIKGNATLNQLRDALDGKYGEWLEMPVEIEDKVNDATGEVVKTVSAEVEHAPLFQLWHAVYSLQNADELAKTLREKFQITDEAVIEALCKIDFVKPGYANKSHKFIRRILPYLMDGYMYNEACAKVGINHSNSMTAAERDARPLAERIELLQKNALRQPVIEKIINQMINLVNRLQQEYGPIDEARVELARELKQSRDERESAYKAINKNERENSTIANRILEDYGIRPSRSRIQKYRMWEESKQRCFYCGKMIDVKQFLSGADVEIEHIVPRSILFDDSYSNKVCACRECNQEKGNLTAMEYMEGKPTGEFEAYKQRVDEAFSEHRISKTKRDHLLWRRADIPQDFIERQLRQSQYIAVKAVEILQQGIRRVWTSGGSVTDFLRHQWGYDEILHTLNLPRYKQVDEMTEWVHYEHAGQEHEVERIKNWTKRLDHRHHAIDALTVALTQQSMIQRLNTLEASHDEMEKQVKEANTPYKEKKSILEKWVTEQPHFEVSEVTDKVDSILVSFRAGKRVTTPARRAIYQGGKRTIVQTGIQVPRGALTEETIYGKSGDKFVVKYPLDHPSMKPENIVDPTIRALVEK

SEQ ID NO: 1221 - protein, 830 aa, unidentified
  REGION 1..830: note = Description of Unknown: uncultivated organism with predicted taxonomy: Fibrobacter
  REGION 1..830: note = MG16-140 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLENGYKEARVLSQEERLKVVDFLDNHEKMTAKDFTKLLRLDKNDEWDLKRYFGKNGVQGNTTKAQLVTALANIPNACEFLRFNLALENSNYVNESTGEILKVISSNFQNEPLYMLWHTVYSLSDKEELKNALNKKYGITDESVLNNLFKIDFIKPGSGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKEICYNVYATSGSVTDFIRRTWGYDEILHQLNFDRYKKGGLTELREYEHKGETHTEERIQDWSKRLDHRHHAIDALVIAMTRQSIIQRLNHLNTERDAMFQEVEKQRKDWKN

SEQ ID NO: 1222 - protein, 797 aa, unidentified
  REGION 1..797: note = Description of Unknown: uncultivated organism with predicted taxonomy: Bacteroidales
  REGION 1..797: note = MG16-141 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSGAATEGHQLTLPQIGRVLYHINQKRGYKHAKADDNGDSKQTKYVEAVNQRYKEIQEAKQTIGQHFYLELLRSKVESGSGPYYTFRIKDKVFPRAAYIAEFDQIMKVQRAYYPDVLTDELIDTLRNRIIFYQRPLKSCKHLVSLCEFEMKPYKTKDGKIVYGGPKCAPRTSPLAQFCAMWETANNITLTNRNNEQYDFSLEERRQIVEHLCTHEALKLTDLYKILGITKKDGWYGGKAIGKGIKGNATLNQLRKALNGKYGEWLEMPIERVDVVDNETAEVFWQVSPKVEETPLFKLWHAVYSIQDADELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPAAEVEAYKQRVDEAFKEGRISKTKRDHLLWHKSDIPTDFIDRQLRQSQYIAVKAVEILQQGIRQVWTSGGSVTDFLRHQWGYDEILHTLNLPRYRKVEDLTEIVHYEHAGQEHDEERIKNWSKRIDHRHHAIDALTVALTRQAY

SEQ ID NO: 1223 - protein, 1154 aa, unidentified
  REGION 1..1154: note = Description of Unknown: uncultivated organism with predicted taxonomy: Bacteroidales
  REGION 1..1154: note = MG16-142 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMKIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1224 - protein, 1048 aa, unidentified
  REGION 1..1048: note = Description of Unknown: uncultivated organism with predicted taxonomy: Deminuibacter soli
  REGION 1..1048: note = MG16-143 effector
YCDLLQICIGKYDVFFRLFKQMRKILGLDLGVGSIGWSLIETDANDNPVAILGIGSRIVPLSTDDANEFSSGNAISKNQKRTQKRTQRKGYDRYQLRRALLTEKLRESGMLPDERLIKLPVLDLWQLRANAATPGKQLELKEIGRVLYHINQKRGYRHSRYDDGDEKSQREYVQQVNQRFRDIRDEGVTIGQHFANKLAENEVTTPKGKFYTYRIKEQVFPREAYVEEFDRIMDCQRGFYPDILTDSTIGVIRDEIIFYQRPLKSCKHLVSVCEFAMREYKTSDGKSVLSGPKVAPRSSPLFQVCKIWESINNLSLKNRSGQVYRFSDEDRQKMFDFLDNHDRMTVTDLYKLLSISKKDGWWGGKAIGKGLQGNTTKAALAKVLGSRSELLRFQLETIDSKRIDTETGEILKVISPSFEKEPLYRLWHIVYSMHERSEVAAALERQFGITDPETVDKLFSIDFIKAGYGNKSARFIREILPYLQVGMQYSDACNYIGINHSNSLTTEDNASRVLLDKLPQLKKNELRQPVIEKILNQMVAVVNALLSQFGPIDEIRVELARELKQSRDERNDAFLKNNKRERENKVIEERIREYGITPSRSRIQKYRLWEESNHLCFYCGQPVGAAEFLSGSGVEIEHIIPRSLLFDDSYANKVCSCRKCNAEKGNSTAYDYMKAKPEGDFEDYLKRIEKFFSEKRISKSKREKLLTPASEIPQDFIDRQLRQSQYIAKKAVDMLKQVCRNVWTTSGSVTDFLRHNWGYDQILHDLNLPRYKEGGMTEMVHYEHNGQEHDEERIIGWTKRLDHRHHAIDALTIASTRQSYIQRLNTLYASRDAMHAEIKKQSAHWQEKHSLLEEWTKQRPHLPVSVVRDSVDGILVSFKPGKRVATPGKRYTYKGKKELIQDGLLIPRGALSEESVYGQITTLEEHVPVKRLFEDPSLIFKPYIRHLVEQRIEEFHGDWKKARLSIGKKPIWLDEGETVALEYATCWKKEYVIRYPVSSLKAKDVNSIVDRHIREIVRKRIDEVGEKDAFKTPLFSDATQMIPVNGIR

SEQ ID NO: 1225 - protein, 1244 aa, unidentified
  REGION 1..1244: note = Description of Unknown: uncultivated organism with predicted taxonomy: Bacteroidales
  REGION 1..1244: note = MG16-144 effector
MKRILGLDLGTTSIGWAVINVDDNLKPVSIESMGSRIVPLSSDDTNEFTKGNAISKNQSRTERRTSRKRYDRYQLRRKYLTAELRKLKMLPDERLIKLPTLELWELRANAASKGHQLTLPELGRVLYHINQKRGYKHAKSDDSSDTKQKAYVAEVNARYSMIKEKNQTIGQYFAEKLKESEVVTPKGKFYTYRTKEQVFPRKAYEAEFDQIMECQKVFYPNLLTEKEISKLRNEIIFYQRNLKSCKHLVSVCDFEKKEYKNKEGKIVFGGPKVAPKSSPLFQICKIWEEVNNLTLKNRKNEELYISLEQRQAMVDFLDTHEKMTLNDMYTILGISKKDGWWGGKAIGRGLQGNTTKIALMNALGNSENVKSLFQFNLHKIDSQLVDEVTGEIIQIIDPKLEKEPLYDLWHTIYSISDKEEFAKALKKKYNITDETIINGLYSIDFVKPGFGNKSAKSIRRILPYLQEGLKYSDACEYAGFRHSESLSKAENETRTLLDELPHINKNELRQPIVEKILNQMINVVNALMNEYGKFDSIRVELARELKQSKDERNTTFLQNEAMQRLNESIAKRLVSENINPTKRIIDKYKFIFPTKGCFDKRTGKFITKNFESLSTVNRCIYCGQSFSLSEALNGDGYEIEHILPRDLICDNSQNNKVLSCRKCNSIKSNKTAFDYMRTQDKNAFEAYLERVESWYKDGIISPAKRERLLLSHEDYLERKRIGKETDEDKKYWEEFVSRQAGETQYISRESIRILKQCCRNVNATSGSITATLRHLWGYDEVLHQLNFERFKNAGLTETVTWESNHGKNKHSKEQIIDWSKRVDHRHHAIDALVVACTQQGFIQRINTLNADETKDLMKRQIETVGVKYDEKKILLDKYLTSLAPFKTQTVANAASNILVSFKPGKKTATTGKRIEYRNGKKHVVQKGIIIPRGALHEEGVYGEIEINGKKHIVKKYKLGKGAQGFVFTGKETYTEKINKKTGEIQIEDKIKNVLDSIVDGSIRAKVLQRLNQGFEEGKDYRNDVKKALENLNDLDKNPIYADDNNTIPIRTVRCITGLSAIVPIKYNDQGKSIGFVKPGNNHHIAIYQDNEGNLREHSVTFWHAVERKKYGVPVIIDNPIQVWDSIKDRQLPESFLEKLPEVNWTYKISLQQNEMFILGMEDDAYDYAIRNQDYSTLGQYLYKVQNVSEKQYRFSLHNMTKFDIKRMNKADKCFYNIQSIDALFRLHPHKVHISLIGKIKEIQE

SEQ ID NO: 1226 - protein, 1266 aa, unidentified
  REGION 1..1266: note = Description of Unknown: uncultivated organism with predicted taxonomy: Bacteroides
  REGION 1..1266: note = MG16-145 effector
PFTQIFLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1227 - protein, 1218 aa, unidentified
  REGION 1..1218: note = Description of Unknown: uncultivated organism with predicted taxonomy: Bacteroidetes
  REGION 1..1218: note = MG16-146 effector
MKKILGLDLGVGSIGWSVIQADEEGNPASLLDIGCRIVPLSTDDANEFSSGNAISKNQMRTQKRTTRKGYDRYQLRRQYLTEELRKLGMLPNERLIKLPVLDLWQLRAYAATPGKKLSLPEIGRVLYHINQKRGYQHSKSDDSDDKSQRDYVQTINNRFATIKTEKKTIGQFFVERLAESEVLTDKGKFYTFRIKEQVFPRKAYVEEFDQIISCQKVYYPDILTDDEIHILRDEIIFYQRPLKSCKHLISRCKFALREYKTADGESIIAGPNVAPRTSPLFQVCKIWESVNNIELKNRDGDSYQFSMEDRQKLFDFLDNNEKLTVTDLKKVLGLNSKDKWWGGKAIGKGLQGNTTKIAIKKALQGHLELLSFNLKSIDSQHIDTQTGEILHEISPDFEKEPLYRLWHIVYSMADPEEMGAAIKRQFGIEDPEILSRLSKIDFVKAGYGNKSARFIRQILPYLQKGLKYSEACDYISINHSNSLTTAENNARKLLSHIPQLQKNELRQPVIEKILNQMVNVVNALIDKHGGIDEVRVELARELKQSKDERNSTFLNNNKRERENKIIEERIAEMGIRPSRSRILKYRLWEEAKHICFYCGQPVGVKEFLEGAEVEIEHIIPRSLFFDDSFANKVCSCRKCNAEKGNRTAFDYMKQKGENEFSDYSRRIEEAFEKKEISKVKRERLLTSAKDIPEDFIDRQLRQSQYISKKAVEMLKQVCRNVWTTSGSVTDFVRHHWGYDNIIHDLNFQRNKNAGQTAIITYEHRGQTHQEERIKEWSKRLDHRHHAIDALTIASTKQSYIQRLNHLNTSRDAMFQELEAQSEEFKEKYSLLERWIKERPHIPVSEVTEAVDGILVSFKAGKRVSTPGKRYTYKKGKRSVAQTGIVVPRGALSEESIYGAISCLEEHVPVKKLFEHPEIIFKSYIREKVENRIREFGGNWKAALQSLKKTPIYLGIDETKPLEYASCWKKEYVIRYPLSSIRKKDVDYIVDQHIRHLVSERIAAVGEKDAFREPLYADKAGKMPIKSVRLFTGLTDSSVSPVKYSHGLPIGFSKPGNNHHYCFYRNRDGELVGHLVSFWHAVERKKYGIPVIIKDTDRLWEEVANRDLPEDFLKNLPPSGLTLEVSLQQNEMFILGMPEEDYQRAIEKSSKNDLNKYLYRVQKISGQYNVFRRNTDTGKEEDSIAQSLGQFIRISSTKGWISYNPHKIHIDILGDICEL

SEQ ID NO: 1228 - protein, 1160 aa, unidentified
  REGION 1..1160: note = Description of Unknown: uncultivated organism with predicted taxonomy: Bacteroidales
  REGION 1..1160: note = MG16-147 effector
MKKKILGLDLGVGSIGWALIETEDNQPKQILGMGSRIVPISKDDNDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQRFYLELLRTRVHREKGDYYTYRIKDQVFPRAAYIAEFDQIMHVQRVYYPEVLTDEFIDTLRNRIIFYQRPLKSCKHLVSLCEFEMRPYKTKDGKIVYGGPKCAPRTSPLAQLCAMWETANNITLTNRNNERFEFTLEQRRQIVDFLCHNKEMKVTHLQKILGISKKDGWYGGKAIGKGIKGNATLNQLRETLQGKYDQWLEMPIKHVDVVDATTSEVFWAVSPEVEETPLFKLWHAVYSLQNADELAKTLREKFQIFDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSREERESAYRAMGQNERRNKEIAEKISEFGIRPSRSRIQKYKMWEESMHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPADFIERQLRQSQYIAVKAVEVLQDGIRHVWTSGGSVTDFLRHQWGYDEILHTLNLPRYRQVEGLTEYVEFEHAGQKHTEERIKNWSKRIDHRHHAIDALTVALTQQGYIQRLNTLEASHDLMEKQVKEAGTHYNEKKSILEKWINEQPHFSVEDVTNVVKGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1229 - protein, 1154 aa, unidentified
  REGION 1..1154: note = Description of Unknown: uncultivated organism with predicted taxonomy: Bacteroidales
  REGION 1..1154: note = MG16-148 effector
MKKKILGLDLGVGSIGWALIETEDNQPKQILGMGSRIVPISKDDGDQFSKGQAITKNADRTARRTARKGYNRYQMRRALLTQALRNNNMLPERMDENVIDLWKLRNDAATEGHQLSLPQIGRVLYHINQKRGYKHSKADENGDSKQTKYVEDVNKRYKDIQEAHQTIGQHFYLELLRSKIERANGPYYTYRIKDQVFPRAAYIAEFDQIMNVQRVYYPEILTDEFIDTLRNRIIFYQRPLKSCKHLVSLCEFEMRPYKAKDGKIVYGGPKCAPRTSPLAQLCAMWETANNITLTNRNNERYEFTLEQRRQIVDFLCHNKEMKVTHLQKILGISKKDGWYGGKAIGKGIKGNATLNQLREALQGKYDQWLEMPIKRIDVVDATTSEVFWAVSPEVEETPLFKLWHAVYSLQNADELTKTLREKFQITDEAVIEALCRIDFVKPGYANKSHKFIRRLLPYLMEGMMYSEACERININHSNSMTREEREQRPLSARIQLLQKNQLRQPVVEKVLNQMINIVNSLKDQYGEIDEARMELARELKQSRDERESAYKAMGQNERRNKEIAAKITEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPSDFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIAQRGIEVPRGALTEETIYGKLGDKFTVKYPLDHPSMKPENIVDSTIRELVQKRVAERGKDAFKEPIYSAEGMKIKSVRCFTSLSENGVVPVKYDEAGRPIGYAKKGNNHHIAIYQDKDGQYQEMVVSFWNAVERKRYGVPVVITNPHEVWDSLLNKDLPQEFLAKLPNDNWQFILSMQENEMFVLGMENDEFNDAIERQDYATLNKHLYRVQKLSTHDYSFRYHTETKVDDKYEGAENGRNASMSLGALVPIRSCGSLFVQFPHKVKVDILGHIHKA

SEQ ID NO: 1230 - protein, 1007 aa, unidentified
  REGION 1..1007: note = Description of Unknown: uncultivated organism with predicted taxonomy: Bacteroidetes
  REGION 1..1007: note = MG16-149 effector
MKRILGLDLGTNSIGWAVVNTDENDKPVSIERMGSRIVPLTSDDTNEFTKGNAITKNQSRTEKRTARKGYDRYQLRREHLTTELRKLKMLPDEKLIKLPVLELWELRGKAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIIECQKEFYPDILTNEEINRLRNEIIFYQRRLKSCKHLVSFCDFEKREYINKVGKVVYGGPKVAPKSSPLFQLCKIWEEVNNLTLRNRKNDELFITIEQRQAMVDFLDTHEKLTLSDMYSILGISKQDGWWGGKAIGRGLQGNTTKIALKKALGDFVNADTLLQFNLKQTDSNLVDEVTGEILQVIDPKLEKEPLYDLWHTIYSISDKEELTNALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFDSIRVELARELKQSKDERNVTFLQNEAMQRLNDSIANRLSSEGIKPTKRTIEKYKFIFPTKGCFDKRTGKFITKNFENLSTVNRCIYCGQPFSLSAALNGDGYEVEHILPRDLICDNSQSNKVLSCRKCNSIKSNKTAFDFMRSQGEHAFETYLERVESWYKDGIISPSKRERLLLSHEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIESAGIKYEEKKVLLDKYLISLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGEIQIEDKIKNVLDSIVDGNIRNKVL

SEQ ID NO: 1231 - protein, 1250 aa, unidentified
  REGION 1..1250: note = Description of Unknown: uncultivated organism with predicted taxonomy: Bacteroidales
  REGION 1..1250: note = MG16-150 effector
MKRILGLDLGTTSVGWALITVDESNNPIDIQDIGVRIVPLAENEGDKFTKGQDITVNADRTLARGIRRNYDRYQMRRRALTEKMRQLNMLPDEHLIKLPVLDLWQLRANAAKQKISLCELGRVLYHLNQRRGYKHARTDSNDSKQKDYVQKINNRYSLLQQLGLTIGQYFAQKLAETAITHNGKTFYVFRIKEQIYPRRAYEEEFDTIMTCQQLFYPTILTDEVINEIRNNIIYYQRDLRSCKHLVSICEFEKRSFYDENGEVKRNKKGEIVYSGPKVAPRTSPLFQVFKNWQSINNLHFHNRRNEDLFITLEQKTHIASIMDNKELLKLKDVHEVLGINNKSGWYCDKAIKAGIKGNTTKTAIIACLSTLPLSIINEIARFNLKTEKTNIVDEESGEIFVRISNNYQDEPLYRLWHIIYSIKDDEERFNAISKFLKDFGIEDDSITNALKDIDFVTPGYANLSAKAISKILPYMMEGLDYSDACEYVGYNHSDSLTKEENASRDLVDKIPLLKKNELRQPTVEKILNQTINIFNQINADLIQKGERIDEVRVELARELKQSKTEREEASAGIRKQQALNDNYANILKSESIRPTRNKILKYRLWTESNKTCFYCDQPVNFKEYLQTTEFEREHVIPKRLIFDDSFANQVCSCSKCNKEKGGLTALDFMRTKANLRNYLDKVDSMYQKHEISGKKRSHLLASYDDYLERKKEGKETKEDIMIWETPIDRQLRLSQYISRKAMEILRMGCREVVATSGSITELIRHTWGYDTILHELNCPDYKEAGLTEIIIDEKTKRQREVISDWTKRLDHRHHAIDALAVACTTHSIVQHINTLHASRKIMRDEIKTSRKEWKDNYLLQQWIKEKMPFDRHYVLHKIASILVSMKAGKKATVPGKRKIYKNGKPQIIQTGIKIPRGQLHEKTIYGAIKQWSGGEEHRKIVTRYKLGIGAAGYVFNGKESCDVIFDKKKKQYVMDDGIDKAIKYIVDKHIQDVIRGRLNEAFPANETYRSEAEKALAEGKTYDGKDRSKKALEQLRTLSEKPLYADKGKTIIIKSVRCFTGLSAVQPLRYNSQNEPIAFVLTKNNHHVAIYSDEKGEYKECVYTFWQAVERSKYRLPLIIKEPHELWREIMKRENDGEHFPDSIIEALPSPNWTFIESLQLNDMFVMDLDDETFEEYITNKNYEKLGKKLYRVQSLSTGDYCFRHHTDTTTDRTNAKLTKKFLRKSLMSFISSNPRKVQISLLGKINRDC

SEQ ID NO: 1232 - protein, 1242 aa, unidentified
  REGION 1..1242: note = Description of Unknown: uncultivated organism with predicted taxonomy: Prevotella
  REGION 1..1242: note = MG16-151 effector
MKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSEIEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGVQGFVFTGKETYEEKVNKKTGEIQIEDKIKNVLDSIVDGNIRTKVLQRLNQGFEEGKDYRNDVKKALGNLNNLDKNPIYADDNKTIPIHTVRCITGLSAIVPIRCNNQGKPIGFVKPGNNHHIAIYQDEEGNLKEHSVTFWHAVERKKYGIPVIIENPTKLWDEIKDKQLPESFMEKLPEVNWTFKVSLQQNEMFILGMEDDTYDVAMGNKDFTLISKFLYRVQSISESDYWFRLHIESQNDKTPQAKQAKKFHRIQSLKGFYQLHPHKVHISVIGKIKEL

SEQ ID NO: 1233 - protein, 1228 aa, unidentified
  REGION 1..1228: note = Description of Unknown: uncultivated organism with predicted taxonomy: Fibrobacter
  REGION 1..1228: note = MG16-152 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERSQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGKIVYDGPKVAPRTSPLAQICRIWEFVNNISLENGYKERRELSLEEKQKVVHFLDNNEKMTATDFSKLLGLGKKNEWDLKRYFGQNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDDSYANKVCACRKCNANKGNKTAFDFMKSQSEDAFNNYVSRVEEYYKNGKISRTKHDRLLTPQSEIPSDFIERQLRQTQYISKKALEMLKEVCRNVYATSGSVTDFIRHTWGYDEILHQLNFDRYKQGGLTEAREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKDIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1234 - protein, 1154 aa, unidentified
  REGION 1..1154: note = Description of Unknown: uncultivated organism with predicted taxonomy: Bacteroidales
  REGION 1..1154: note = MG16-153 effector
MKKHILGLDLGVGSIGWALIETEDDQPKQIIGMGSRIVPISKDDSDQFSKGQAISKNADRTARRTTRKGYDRYQLRRALLTKVLRQNRMLPERMDENVIDLWKLRSDAATEGHQLTLPQIGRVLYHINQKRGYKHAKADDNVDSKQTKYVEAVNQRYAEIQEAKQTVGQHFYLELLRSKVESGNGPYYTFRIKDKVFPRAAYIAEFDQIMKVQKVYYPEVLTDEFIDTLRNRIIFYQRPLKSCKHLVSLCEFEMKPYKTKDGKIVYGGPKCAPRTSPLAQLCAMWETVNNITLTNRNNERYEFSLDERKQLVEHLCTHEALKLTDLYKILGITQKDSWYGGKAIGKGIKGNATLNQLRKALNGKYSEWLEMPIERIDAVDDETAEVFWQVSPKVEETPLFKLWHAVYSIQDADELAKTLRNKFGIDDQEVIDALCKIDFVKPGYANKSHKFIRRLLPYLMDGMMYSEACARIGINHSNSMTAVERDARQLSDHIELLQKNALRQPVIEKILNQMINLVNRLQQEYGPIDEARVELARELKQSREEREGAYRRNNQNERLNKEIIAKIEEMGIRPSRSRIQKYKMWEENNHRCMYCGKTVSLAEFLNGADVEIEHIIPRSILFDDSFSNKVCACRECNHEKGNMTALDYIETKPAAEQEAYKQRVDEAFKEGRISKTKRDHLLWHRSEIPTDFIERQLRQSQYIAVKAVEILQQGIRQVWTSGGSVTDFLRHQWGYDEILHTLNLPRYRQVEDLTEMVHYEHAGQEHDEERIKNWSKRIDHRHHAIDALTVALTRQAYIQRLNTLEASHDFMEKQVKEAGTQYNEKKSILEKWILEQPHFSVDDVTQSVDSILVSFRAGKRVTTPARRAIYQGGKRTIVQTGLQVPRGALTEDHIYGKLGDKFVYKYALTDQSMHPENIVDPTIRAIVQKRVAERGKDAFKEPLYSAEGMEIKSVRCYTSLSENGVVPVKQDEHGRNIGYAKKGNNHHVAIYQDKDGQYQEMVVSFWDAVERKKYGVPVVITNPRAVWDSIMDKDMPQEFLEKLPNDDWTYILSMQENEMFVLGMEEDEYNDAIEAKDYAALNKHLYRIQNISSLFYIFRYHTETKVDDKYEGIANGRNASMSLGALIPIRSFKALFAQFPHKVKIDIMGRITRA

SEQ ID NO: 1235 - protein, 1154 aa, unidentified
  REGION 1..1154: note = Description of Unknown: uncultivated organism with predicted taxonomy: Bacteroidales
  REGION 1..1154: note = MG16-154 effector
MKKKILGLDLGVGSIGWALIETEDNQPKQILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMNVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDAATSEVFWAVNPEVEETPLFKLWHAVYSLQNAEELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESQHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKEPLYSAEGMEIKSVRCFANVTDNSVVPIKYNEEGQPIGYAKKGNNHHVAIYTDKSGKPQESVVSFWDAVERKRYGVPVVITNPHEVWDNLLNTDFPEEFLAKLPEDDWQYLFSMQENEMFVLEMEDDEFYDAIERQDYASLNKHLYRVQKIRSGEYTFRYHTETKVDDKYEGVANGTNTSFQLGALVSIRGFSSLFAKHPHKVKIDLLGHIHKA

SEQ ID NO: 1236 - protein, 1217 aa, unidentified
  REGION 1..1217: note = Description of Unknown: uncultivated organism with predicted taxonomy: Bacteroidales
  REGION 1..1217: note = MG16-155 effector
MKRILGLDLGVGSIGWSLIQADDEGNPQSILDIGCRIVPLSPDDTNEFSSGNAISKNRKRTQKRTCRKGYDRYQQRRQNLTDELRGLGMLPDERLIKLPVLDLWQLRADAATPGKKLTLPEIGRILYHINQKRGYLHSKTDEDDKAQRDYVQAINNRFAHIKAEGKTIGQYLAGKLADSEVTTDKGQFYTFRIKEQVFPRKAYQEEFDQIIACQRIHYPDILTEEVIHRLSDEIIFYQRPLKSCKHLISQCEFAMREYKTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1237 - protein, 1154 aa, unidentified
  REGION 1..1154: note = Description of Unknown: uncultivated organism with predicted taxonomy: Bacteroidales
  REGION 1..1154: note = MG16-156 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYLDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1238 - protein, 1223 aa, unidentified
  REGION 1..1223: note = Description of Unknown: uncultivated organism with predicted taxonomy: Fibrobacter
  REGION 1..1223: note = MG16-157 effector
MKKILGLDLGVSSIGWSVISVDDNGDPSDILGMGSRIVPLSTDDANEFSTGNAISKNQKRTQKRTARKGYDRYQLRRENLTVELRKHKMLPDEHLIKLPVLKLWTLRASAATEGHQLTLPEIGRVLYHINQKRGYKHAKADEAGDKKQTDYVAAVNQRFAMIKERGQTIGQYFAEKLKENEVVTEKGKFYTYRTKEQVFPRGAYIAEFDQIITVQRKFYPQILTEEFINRLRNEIIFYQRNLKSCKHLVSICEFEKHEYKNKEGKTVFDGPKVAPRTSPLFQICRIWEFVNNIRLENGYKEARELTQEERLKVVEFLDNHEKMTAKDFSKLLKLNKDNEWDLKKYFGKNGIQGNTTKTKLATAIANVPNANDLLRFDLTLENSNFVNEATGEVLKVISSDFQNEPLYMLWHTVYSLSDKDELKSSLEKKYHITDESIVDNLFRIDFIKPGFGNKSAKAIRRILPFLQEGLVYSEACAEAGYNHSNSLTKTENEARTLLARLPQIKRNELRQPVIEKILNQMVNVVNAIYDEYGQIDEIRVELARELKQSKDERKATAANIAKRERENKAIAAKIEEFGIRPSRNRIQKYRLWEESEQKCFYCGQPVDAREFLSGLDVEVEHIIPKSLLFDDSFANKVCACRKCNAAKGNRTAFDYMKSQSSNAFDAYIKRVNDFYKDGKISKTKNERLLTTQSEIPSDFIERQLRQTQYIAKKALEMLKEVCYNVYATSGSVTDFIRHTWGYDEILHQLNFDRYKKGGLTELREFDHKGATHTEERIQNWSKRLDHRHHAIDALVIAMTRQSIIQRLNHLNTERDAMFQEVEKQSKEWKNDYSLLQEWLRERKHFSTDEVAQKVSDILASFKAGKRVATIGKRIKYEQGKKKALQTGIVIPRGPLSEESVYGKIKVLDPSKPIKFLFENPQSIISAEIRTAITNRLSKFENDIKKAIQSLKDDPIILANGKNLETADCYKEEYVIKYSLNGFKAKDIESVVDGHIKEILYKRLEEFNGNEKEAFKDIENKPIFADSAHKIPIRNVRCFTGLSAVVPVKQDNNGNNIGFVKPGNNHHIAIYKDENGNLQESVVTFWHAVERKKYGLPIIITNPAEVWEIAKAKDCPSEFLACLPNEKWSFVQSLQINEMFIMGLDDETYEKTLSEHNYTLINQHLYRVQKLTSNDYFLRFHLETKIDDSAEAKQMGKVLRKSLKTFIQDNPHKVKVSVLGKLIT

SEQ ID NO: 1239 - protein, 1217 aa, unidentified
  REGION 1..1217: note = Description of Unknown: uncultivated organism with predicted taxonomy: Bacteroidetes
  REGION 1..1217: note = MG16-158 effector
MRKILGLDLGVGSIGWSLIETDTKDNPVAILGMGSRIVPLSTDDSNEFSSGNAISKNQKRTQKRTQRKGYDRYQLRRALLTEKMRELGMLSDERLIKLPVLELWQLRANAATPGKQLELKEIGRVLYHINQKRGYKHSRSDDGDEKSQREYVQQVNQRFRDIRDEGLTIGQHFANKLAENEVITPKGKFYTYRIKEQVFPREAYIEEFDRIMDCQQVFYPDILTDTIIREIRNEIIFYQRPLKSCKHLVSVCEFAMREYKTSDGKSILSGPKVAPRSSPLFQVCKIWESVNNLTLKNRSGQVYHFSDEQRQRMFDFLDNHERMTVTDLYKLLNISKKDGWWGGKSIGKGLQGNITKAALAKALSNHRDLLRFQLETIDSKRIDTETGEILKVISSSFEKEPLYSLWHIVYSMHERSEVAAALERQFGITDPDTIDRLFAIDFIKAGYGNKSARFIREILPYLQAGMQYSDACNYIGINHSNSLTTEENANRALLDKLPQLKKNELRQPVIEKILNQMVAVVNALLSRFGPIDEIRVELARELKQSRDERNNAFLNNNKRERENKVLEERIREYGISPSRSRIQKYRLWEESNHLCFYCGQPVGAAEFLSGSGVEIEHIIPRSLLFDDSYANKVCSCRKCNAEKGNSTAYDYMKAKPEGDFEDYLKRIETFFSEKRISKAKRDKLLTPATDIPQDFIDRQLRQSQYISRKAVDMLKLVCRNVWTTSGSVTDFLRHNWGYDQILHDLNLPRYKEGGMTEVVHYEHNGQEHDEERIIGWTKRMDHRHHAIDALTIACTRQSYIQRLNTLNASRDAMHAEIEKQNAYWQEKHSLLEEWTRQRPHLPVSVVRDYVDGILVSFKPGKKVATPGKRYTYNGKKELAQDGLLIPRGALSEESVYGQITSIVEHVPVKRLFEDTSLIFKPYIRNLVEQRIEEYHGDWKKARLSIGKKPIWLDKGETIALEYATCWKKEYVIRYPVSSLREKDVDSIVDRHIREIVQKRIDEVGEKDAFKTPLFYDAAQKIPIKSIRCFTGLDAVEAVKYANGIPIGFSKPGNNHHIAIYRDKEGNRFEHVVSFWHAVERKRFGLPVIIQDTDSVGDQIQGISLPESFLKNLPAPGATLELSLQQNEMFILGMKEDEFNDAIREKDNTALNKHLYRVQKLGSLYYVFRYHTETQIDDSNNAIIMHKFYRCRSLSAFDALNPHKVRVSITGEIMQGDD

SEQ ID NO: 1240 - protein, 971 aa, unidentified
  REGION 1..971: note = Description of Unknown: uncultivated organism with predicted taxonomy: Bacteroidetes
  REGION 1..971: note = MG16-159 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQVCKNVYSTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIK

SEQ ID NO: 1241 - protein, 1051 aa, unidentified
  REGION 1..1051: note = Description of Unknown: uncultivated organism with predicted taxonomy: Fibrobacter
  REGION 1..1051: note = MG16-160 effector
MKKILGLDLGVSSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGHQLSLPEIGRVLYHINQKRGYKHAKADEAGDKKQTEYVENVNKRFAMIKELGLTIGQFFANKLKESEVISEKGTFYTYRTKEQVFPRGAYIAEFDQIIEVQRKFYPQVLTDEFINRLRNEIIFYQRNLKSCKHLVSLCEFEKHEYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRKPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQFIANADIKSAVTNRLIQHENDVKKAVLSLKKSPIVLANGKTLETADCYKEEYVIKYSLNGFKAKDIDSVVDTHIKDVLYKRLEEYDGNEKEAFKDIENNPIYADATHKIKIRNVRCFTGLSAVVPVKKDEN

SEQ ID NO: 1242 - protein, 1153 aa, unidentified
  REGION 1..1153: note = Description of Unknown: uncultivated organism with predicted taxonomy: Bacteroidales
  REGION 1..1153: note = MG16-161 effector
MKKNILGLDLGVGSIGWALIETEDDQPKQIIGMGSRIVPISKDDSDQFSKGQAISKNADRTARRTTRKGYDRYQLRRAMLTETLRHNGMLPERMDENVIDLWKLRSDAATEGHQLTLPQIGRVLYHINQKRGYKHAKADDNGDSKQTKYVEAVNQRYVEIQETHQTIGQHFYLELLRSKVESGNGPYYTFRIKDKVFPRAAYIAEFDQIMNVQKAYYPEVLTDELIETLRNRIIFYQRPLKSCKHLVSLCEFEMRPYKTKEGKIVYGGPKCAPRTSPLAQLCAMWEAANNITLTNRNNERYNFSLEERKQIVEHLCSHEALKLTDLYKILGITKKDGWYGGKAIGKGIKGNSTLNQLRKALNGKYGEWLEMPIEHMDVVDEETAEVLWQVSPQVEETPLFKLWHAVYSLQDADELAKTLRNKFNITDQDVIDALCKIDFVKPGYANKSHKFIRRLLPYLIEGMMYSEACARIYINHSNSMTVAERDARPLAEHIELLQKNALRQPVIEKILNQMINLVNRLQQEYGPIDEARVELARELKQSREERENAYKRNNQNERLNKEIAAKIEEMGIRPSRSRIQKYKMWEESDHRCMYCGKMVSLAEFLNGADVEIEHIIPRSILFDDSYSNKVCACRDCNREKDNLTALDYLETKTGAELEAYKQRVDDAFKEGRISKTKRDHLLWRREDIPSDFIERQLRQSQYIAVKAVEILQQGIRKVWTSGGSVTDFLRHQWGYDEVLHTLNLPRYHKVEGMTEFVQYEHAGQTHEEERIKNWTKRVDHRHHAIDALTVALTRQAYIQRLNTLEASHDLMEKQVKDAGTLYNEKKSILEKWINEQPHFSVDEVTRQVDGILISFRAGKRVTTPARRAIYKGGKRIIVQTGLQVPRGALTEETVYGKLGDKFVVKYPLAHPSMKSENIVDPTIRAIVQKRIDERGKEAFKEPLYSAEGMEIKSVRCYTSLSENGVVPVKQDGQGNNIGFAKKGNNHHVAIYQDKNGQYQEMVVSFWDAVERKKYGIPVVITNPHAVWDSVLDKESPQEFLEKLPNDDWKYILSMQENEMFVLGMEDGDFEHAIETQNYAALNKHLYRVQKVSSKFWCFRYHTETMVDDKYGDTKNEQWSFQMGKAFRASSFDGLFRQFPHKVKIDIMGRITKA

SEQ ID NO: 1243 - protein, 1224 aa, unidentified
  REGION 1..1224: note = Description of Unknown: uncultivated organism with predicted taxonomy: Prevotella
  REGION 1..1224: note = MG16-162 effector
MKKVLGLDLGTNSIGWCLIEKSDDNIPQRILRMGSRIVPISSDEESGYTKGNAVSKNAERTHKRTARKCYDRYQLRRQALMSLLKRLGMEPSNELIFEQTPMKIWQTRADAATKKISLPELGRVLLHINQKRGYKHSRLNNFDAKETSYVQEVNSRYDELKAEGLTVGQHFALKLKKNEKTSANGRKYYTYRIKEQVYPRHAYEEEARIILNTQRIFYSDILTEDVCKEFLDTIFYQRDLKSCKNLVSLCEFESYTIKKDGKEITIGPKVCPRTSPLAQLSSILETANNITIRNKRNDELYISPEQRQAIADFLDNNEVMKLTNLYNILHIGKKDGWWAGKAIGKGLKGNTTKMQIRAALSNLPSEQVNMLLKFELEFEDYVDKETGEVRQRVDNTQVEKQPLYRLWHLIYSIKDEDELSNALRRMDIKDEETIRKLCSLDFRSAGYAKKSAKAIGRILPYLMEGMMYSQACEQAGFDHSRRVDPGRTLLSALPQIQKNEFRQPVVEKILQQLVNIINSLISKEGTIDEIRVELARELKQSKDERNEAFKRNNQNEKKNKEYAEHIKEYQLTPTRNRLLKWKLYEESDHACMYCGQPIKVREFLQGADVEREHIIPKGLLFDNSFTNQVCSCRSCNSKKGMRTAYDFIEAEKGEEGLRSYIEHINYLFDKKNISRSKYNRLLVSYKAYLQRKVQGKETEEDKNLWENFIDRQLRQSQYIARKAIEMLQQICKNVYSTSGRVTDFVRHQWGYDEILHDLNFDRYKKAGLTTMVTQLQSGDEVEVERIKDWTKRLDNRHHAVDALAIACTTQGMIQRLNTLNASRDEMQAELNDKNGSIMDPNRSMLEKWVSIQPHITYAEAKNEVDKIIISQRPNTRITVPGKRYIQKNGKRTPVQTGIIVPRGALHAEFVYGRIMKQKPTSDGVVKIPQYVRKYKLGIGAQGYLFNGKEFYKEELKKDPRTGLSTIAVTDKINDVLEKIVDGGIRKRILERLNRGFEDGKDYRSNVPRALANLKNLDDDPIYSDDAKTRPILSVRKEVVSTTMVIVRNDRNGRPLAFAEPDGNHHVAFYKNENGLIEERIVTKWHAVQRKLHHVPIIIDNPSATWSDMLGRTDVPEEILKELPKDNSIFMLSLQIGEAFVMGMEESDYQKAIEEGNKQVLAEHLYFVQNLSSSNYRLRRHVESSYDITGMNKEDQRFLNIKSIGALFNYNPHKVKITVLGDIIP

SEQ ID NO: 1244 - protein, 1261 aa, unidentified
  REGION 1..1261: note = Description of Unknown: uncultivated organism with predicted taxonomy: Bacteroides
  REGION 1..1261: note = MG16-163 effector
FLYFFAIFAKNKKQIIQYTMKKILGLDLGTNSIGWAVVNAEENWKPVSIESMGSRIIPLSSDDTNEFTKGNAITKNQSRTEKRTARKRYDRYQLRREYLTATLRKLKMLPDESLIKLPILELWELRGKAACKGQQLSLPELGRVLYHINQKRGYKHAKSDESSDTKQKAYVAEVNARYAMIKKRNQTIGQYFAEKLKESEIETPKGKFYTYRTKEQVFPRKAYEAEFDQIMACQKVFYPDILTEKEINKLRNEIIFYQRRLKSCKHLVSICDFEKQEYKNKEGKIVFGGPKVAPKSSPLFQICKIWEEVNNLTLKNRKNDELFISLEQRQAMVDFLETHEKLTLSDMYAILGISKKDGWWGGKAIGRGLQGNTTKIALKKALGDFENAERLLQFNLYKTDSNLVDDTTGEIIQIIDSKLEKEPLYDLWHTIYSISDKEEFGKALKRKYNITDEDIINRLYSIDFVKPGFGNKSTKAMRRILPYLQEGLKYSDACEYAGFKHSESLTKSENEARPLLDMLPSINKNELRQPIVEKILNQMINVVNALMNEYGKFDSIRVELARELKQSKDERNTTFLQNEAMQRLNESITKRLESENIKPTKRIIEKYKFIFPTKGCFDKRTGKFITKNFEDLSTINYCIYCGQPFSLSAALNGDGYEVEHILPRDLICDNSQNNKVLSCRRCNSIKSNKTAFDFMRSQEKNAFEAYLERVETWYQDGIISPGKRERLLLSHEDYLERKRLGKETDEDKKYWEEFVSRQARETQYISRESIRILKQCCRNVNATSGAVTAILRHLWGYDEILHQLNFERYKNAGLTETVIWESNHGKNKHSREQIVDWSKRVDHRHHAIDALVVACTQQGFIQRINTLNADETKGLMKKQIETAGLKYVEKMALRDKYLISLTPFKTQAVANAVNNILVSFKPGKRTATTGKRIEYKEGKRHIVQKGIIIPRGPLHEEGVYGSIKINGEKQIVKKYKLGKGAQGFVFTGKETYEEKVNKKTGEIQIEDKIKNVLDSIVDGNIRTKVLQRLNQGFEEGKDYRNDVKKALENLNNLDKNPIYADDNKTIPIHTVRCITGLSAIVPIKYNNQGKPIGFVKPGNNHHIAIYQDEEGNLKEHSVTFWHAVERKKYGIPVIIENPTKLWDEIKDKQLPESFLEKLPEVNWTFKVSLQQNEMFILGMEDDTYDVAMGNKDFTLISKFLYRVQSISESDYWFRLHIESQNDKTPQAKQAKKFHRIKSLKGFYQLHPHKVHISVIGKIKEL

SEQ ID NO: 1245 - protein, 1222 aa, unidentified
  REGION 1..1222: note = Description of Unknown: uncultivated organism with predicted taxonomy: Prevotella
  REGION 1..1222: note = MG16-164 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLKHIPVIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1246 - protein, 1159 aa, unidentified
  REGION 1..1159: note = Description of Unknown: uncultivated organism
  REGION 1..1159: note = MG16-165 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYAEIKEARQTIGQHFYLELLRSKVESGNGPYYTFRIKDKVFPRAAYIAEFDQIMQVQRAYYPEVLTDELIDTLRNRIIFYQRPLKSCKHLVSLCEFEMKPYKTKDGKIVYGGPKCAPRTSPLAQFCAMWETANNITLTNRNNEQYDFSLEERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQDVIEALCKIDFVKPGYANKSHKFIRRLLPYLMEGMMYSEACARIGINHSNSMTAAERDARPLAERIELLQKNALRQPVIEKILNQMINLVNRLQQEYGPIDEARVELARELKQSREEREGAYRRNNQNERLNKEIAAKIEEMGIRPSRSRIQKYKMWEESNHRCMYCGKTVSLAEFLNGADVEIEHIIPRSILFDDSFSNKVCACRECNHEKGNMTALDYLETKPATEVEAYKQRVDEAFKEGQISKTKRDHLLWHRSDIPTDFIDRQLRQSQYIAVKAVEILQQGIRQVWTSGGSVTDFLRHQWGYDEILHTLNLPRYRQVEDLTEIVHYEHAGQEHDEERIKNWSKRIDHRHHAIDALTVALTRQAYIKRLNSLNAEFTREEMLKEVEEANTVYNEKKSLLEKWILEQPHFSVDDVTNSVDSILVSFRAGKRVTTPARRAIYQGGKRTIVQRGLQVPRGALTEETIYGKLGDKFVVKYPLDHPSMKPENIVDPTIRALVQKRVAERGKDAFKEPLFSAEGMEIKSVRCFTSLSENGVVPVKQDEQGRNIGYAKKGNNHHVAIYKDKDGQYQEMVVSFWDAVERKKYGVPVVITNPHDVWDSIMDKDMPQEFLEKLPKDDWSYLLSMQENEMFVLGMEEDEFNDAIEAKDYATLNKHLYRVQKVARNDYWFRYHTETTVDDKYGEGDESKVNLGWSVEMGKVYRVRSCGALFDLFPHKVKIDIMGRITKA

SEQ ID NO: 1247 - protein, 1092 aa, unidentified
  REGION 1..1092: note = Description of Unknown: uncultivated organism with predicted taxonomy: Bacteroidales
  REGION 1..1092: note = MG16-166 effector
MKKVLGLDLGVGSIGWCLIEKEDDNTPKRILRMGTRIVPIGSDEESSYTKGNAFSKNADRTAKRTARKCYDRYQLRRHALVDLLKQLGMEPTHKLIYEQTPLGLWQKRADAASKEITLEELGRVLLHINQKRGYKHSRLDNSKSKETAYVQEVNSRYDQLKDEGLTIGQHFAAKLKENEQTSADGKKYYNYRIKEQVYPRHAYEEEVKKILDVQQQYYADLLTDDVCKEIFNIIFYQRDLKSCKNLVSHCEFESYTITKNGKEITIGPKVAPKTSPLAQLSSILETVNNISIRNRRNDELYISPEQKKALADFLDNNEVMKLTDLYRILNIEKKDGWWAGKAIGKGLKGNTTKCEIRKALGNLTKEQVNSLTAFDLVFEEYVDVETGEVRKRVDNNHAEKQPLYRLWHLIYSIKNEEELKGALRNMGIEDEETLQKLSNLDFRNPGYANKSAKAIGRILPYLMEGMMYSQACEQAGFDHSRRINPERQLLKALPQIQKNELRQPVVEKILQQLVNIVNALLAKEGNIDEIRVELARELKQNREERNEAFKRNAQNEKLNKEYAERIKEYGLTPTRNRIMKMKMWEESENTCMYCGQPVDVVEFLQGADVEREHIIPRGLLFDNSFTNQVCSCRKCNSQKGMRTAYDFIEDEKGQEGLESYIKHINYLFDKKKINRSKLNRLLVSHKAYINRKSLGKETEEDKQLWENFIDRQLRLSQYIAKKSVEMLQQICRNVYVTSGSVTDFVRHQWGYDELLHDLNFERYKKAGLTAMVKQLHSGKEVEVERIKDWTKRLDNRHHAVDALAIACTTQGMIQRLNTLNASRDDMLEELNSKKRVADPNRSMLEKWLYAQPHVSYALAKEELDKIIVSQRPNTRITVPGKRYVTKNGKQTLAQTGIVVPRGALHAEFVYGRIMKQEADGKTLTPQFVRKYKLGIGAQGFLFNGKEFYKEDLKKDAKTGLSTIVVTDKIKEVLDKVVDGGIRRRILDRLNRGFEEGTDYRANVGKALANLKNLDEDPIYSDDAKTRPIRTVRKYVNSSTMVAVRKDKNGRPLSFVEPDGNHHVAFYQDDNGIITESIVTRWQAVQRKLSDIP

SEQ ID NO: 1248 - protein, 1162 aa, unidentified
  REGION 1..1162: note = Description of Unknown: uncultivated organism with predicted taxonomy: Bacteroidales
  REGION 1..1162: note = MG16-167 effector
MKTKILGLDLGVGSIGWALIETEDNQPKQILGMGSRIVPISKDDGDQFSKGQAITKNADRTARRTARKGYNRYQMRRALLTQALRNNNMLPERMDENVIDLWKLRSDAATEGHQLTLPQIGRVLYHINQKRGYKHSKADENGDSKQTKYVEEVNRRYKDIQEAHQTIGQHFYLELLRSKIERANGPYYTYRIKDQVFPRAAYIAEFDQIMNVQRIYYPEVLTDEFIDTLRNRIIFYQRPLKSCKHLVSLCEFEARPYKTKDGKIVYGGPKCAPRTSPLAQLCAIWETANNITLTNRNNERFEFTLEQRRQIVDFLCHNKEMKVSHLQKILGISKKDGWYGGKAIGKGIKGNATLNQLRDALQGKYDQWLEMPIKHIDVVDATTSEVFWAVSPDVEETPLFRLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRSSRSRIQKYKMWEESLHQCFYCGKTIDLSEFLNGADVEIEHIIPRSILFDDSFSNKVCACRRCNQEKGNQTAMEYMETKSASEQEAYKQRVDEAFTTKRISLTKRDHLLWHKADIPSDFIDRQERLSQYIAVKAVDLLQQGIRQVWASSGTVTFFMRHQWGYDEILHTLNLPRYRRVEGMTEFVDFEHAGQKHTEERIKNWSKRIDHRHHAIDALTIALTRQAYIQSLNTLSSEITREEMIEIIKETGKVYKEKTSLLDKWARELPHFSVEDVTNAVDGILVSFRAGKRVTTPARRAIYKGGKRVIAQRGIEVPRGALTKDTIYGKQGESYVVKYPLTHQSMKADNIVDPTIRALVKARLAAYNNNANEAFKTPLYSAEGMEIKSVRCVARLTENGVIPIKYNKQGMAIGYAEKGNNHHVAIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 1249 - protein, 901 aa, unidentified
  REGION 1..901: note = Description of Unknown: uncultivated organism with predicted taxonomy: Barnesiella viscericola
  REGION 1..901: note = MG16-168 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKNREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYK

SEQ ID NO: 1250 - protein, 1154 aa, unidentified
  REGION 1..1154: note = Description of Unknown: uncultivated organism with predicted taxonomy: Bacteroidales
  REGION 1..1154: note = MG16-169 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGSYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKLLDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNEHENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1251 - protein, 1217 aa, unidentified; identical to SEQ ID NO: 1219
  REGION 1..1217: note = Description of Unknown: uncultivated organism
  REGION 1..1217: note = MG16-170 effector

SEQ ID NO: 1252 - protein, 1153 aa, unidentified; identical to SEQ ID NO: 1242
  REGION 1..1153: note = Description of Unknown: uncultivated organism with predicted taxonomy: Bacteroidales
  REGION 1..1153: note = MG16-171 effector

SEQ ID NO: 1253 - protein, 815 aa, unidentified
  REGION 1..815: note = Description of Unknown: uncultivated organism with predicted taxonomy: Prevotella brevis
  REGION 1..815: note = MG16-172 effector
MKKHILGLDLGVGSIGWALIETEDDQPKQIIGMGSRIVPISKDDSDQFSKGQAISKNADRTARRTTRKGYDRYQLRRALLTQVLRQNGMLPERMDENVIDLWKLRSDAATEGHQLTLPQIGRVLYHMNQKRGYKHAKADDNGDSKQTKYVEAVNQRYTEIQEAKQTVGQHFYLELLRSKVESGNGPYYTFRIKDKVFPRAAYIAEFDQIMKVQKAYHPEVLTDEFIDTLRNRIIFYQRPLKSCKHLVSLCEFEMKPYKNKDGKIVYGGPKCAPRTSPLAQLCTMWETVNNITLTNRNNERYEFSLDERRQLVEHLCTHEVLKLTDLYKILGITKKDGWYGGKAIGKGIKGNATLNQLRKALNGKYSDWLEMPIERIDAVDNETAEVFWQVSPKVEETPLFKLWHAVYSIQDAEELAKTLRNKFGIDDQEVIDALCKIDFVKPGYANKSHKFIRRLLPYLMEGMMYSEACARIGINHSNSMTAAERDARPLAEHIELLQKNALRQPVIEKILNQMINLVNRLQQEYGPIDEARVELARELKQSREEREGAYRRNNQNERLNKEIAAKIEEMGIRPSRSRIQKYKMWEETNHRCMYCGKTVSLAEFLNGADVEIEHIIPRSILFDDSFSNKVCACRECNHEKGNMTALDYIETKPAAEVEAYKQRVDEAFKEGQISKTKRDHLLWHKSDIPTDFIDRQLRQSQYIAVKAVEILQQAIRQVWTSGGSVTDFLRHQWGYDEILHTLNLPRYRQVEDLTEIVHYEHAGQEHEEERIKNWSKRIDHRHHAIDALTVALTRQAYIQRLNSLNAEFTREEMLK

SEQ ID NO: 1254 - protein, 1266 aa, unidentified; identical to SEQ ID NO: 1226
  REGION 1..1266: note = Description of Unknown: uncultivated organism with predicted taxonomy: Bacteroides
  REGION 1..1266: note = MG16-173 effector

SEQ ID NO: 1255 - protein, 1149 aa, unidentified
  REGION 1..1149: note = Description of Unknown: uncultivated organism with predicted taxonomy: Bacteroidetes
  REGION 1..1149: note = MG16-174 effector
MKKKILGLDLGVGSIGWALIETEDNQPKQILGMGSRIVPISKDDNDQFSKGQAITKNADRTQRRTTRKGYNRYQMRRALLTQALRNNNMLPERMDENVIDLWKLRSDAATEGHQLTLSQIGRVLYHMNQKRGYKHSKADDNGDSKQTKYVEEVNQRYKEIQEAHQTIGQHFYLELLRSKIERANGPYYTYRIKDQVFPRAAYMAEFDQIMQTQRVFYPEVLTDEFIDTLRNRIIFYQRPLKSCKHLVSLCEFEARPYKTKEGKIVYGGPKCAPRTSPLAQLCAIWETTNNITLTNRNNEKYEFTLEHRRQIVDFLCHNKEMKVSHLQKILGIGRNDGWYGGKAIGKGIKGNATLNQLRDALQGKYDQWLEMPIKRVDVVDATTGEVFWAVSAEIEETPLFRLWHAVYSLQNAEELAKTLREKFLITDESVIEALCRIDFVKPGYANKSHKFIRRLLPYLMEGMMYSEGCERININHSNSMTREEREQRPLKEHIQLLQKNQLRQPVVEKVLNQMINIVNSLKDQYGEIDEARVELARELKQSRDERESAYKAMGKNERRNKEIAEKIAEFGIRPSRSRIQKYKMWEESMHQCFYCGKTIDLAEFLNGADVEIEHIIPRSILFDDSFSNKVCACRRCNQEKSNQTAMEYMETKPVGELEAYKRRVDEAFTAKRISKTKRDHLLWRKADIPTDFIERQLRQSQYIAVKAVEVLQDGIRQVWTSGGSVTDFLRHQWGYDEILHTLNLPRYRQVEGLTEFVDYEHAGQKHTEERIKNWTKRIDHRHHAIDALTVALTQQGYIQRLNTLEASHDFMEKQVKETGTHYNEKKSILEKWINEQPHFSVEDVTSAVDGILVSFRAGKRVTTPARRAIYKGGKRVIVQRGIEVPRGALTNEFVYTKKGNKYARKYPINAISNPDNIVDETIRQLVKSRLIACGGNTNEAFKTPLYSAEGMEIKTVRCFNNKLSDRGVVAIKYNENNEPIGYAETDNNHHMAIYRQKDGSLKEKIVSFWDAVERKRYGVPVVIANPHEVWDSLLNTEFPQEFLAKLPKDDWQYVLSMQENEMFVLGMEDDEFNDAIERQDYTALNKHLYRVQSISHDDYYFCHHTETKATEKSESLKLGKTLRIRGVNSLKNYFPHKVKVDILGHIHKV

SEQ ID NO: 1256 - protein, 1258 aa, unidentified
  REGION 1..1258: note = Description of Unknown: uncultivated organism with predicted taxonomy: Prevotella
  REGION 1..1258: note = MG16-175 effector
MKNILGLDLGTTSVGWALIKVDDKNNPIDIQDMGVRIVPLAENEGDKFTKGQDITVNADRTRARGQRRNYDRFQLRRQALTEKLRSLNMLPDEHLIKLPIMELWQLRANAVTQKVSLNELGRILYHLNQKRGYKHSRTDAKDSKQRAYVKEINNRYGELIKSGMTIGQFFAKKLSETAVTVEGKTFYVYRIKDQIFPRKAYEEEYDSIMKCQQTFYQEILTNDVIDEIRNRIIYYQRDLRSCKHLVSVCEFEKRCFYDAEGNVKRNKKGEIIYDGPKVVPRTSPLFQIFKNWQSINNLRFHNRKNEYLYITKEQKQQIANIMDIHKVLKLEDVQNVLDITSESGWYCDKAIKAGIKGNTTKHAILSVLSSLPQSKITELTRFNLETEATNLVDEETGEVLVRIKSTYQEEPLYRLWHIIYSIKNEDERFNAISNLLKEFCIEDDSIASALKDLDFVTPGYANLSAKAISKILPYMMEGIDYSESCAYVGYNHSDSITKEENKRRELLDQIPALKKNELRQPTVEKILNQTINIFNQINTNLKKNGERIDEVRIELARELKQSKDERKETENGIRKQQKMNDEYANILKEEGIRPTRNRVLKYRLWRESNETCFYCERPINFNEFLKFSDIEREHIIPKKLIFDDSFANQVCSCRKCNKEKGGRTALDYMQTTPNLQMYLDKVDKMFQEHKISGKKHLHLLASYEDYLIRKKEGKETKDDIKIWETPIERQLRLSQYISRKAQELLRTACRDVIATSGSITDLIRHTWGYDTILHELNFDCYKKAGLTEFIKDEKTGKIREVIQDWTKRLDHRHHAIDALAVACTSRSIIQRINTLHASREDIRKEIKSTRKEWQENDLLQQWIKEKMPFDRKYVLHKVASILVSMKAGKKATVPGKRKIYKNGKPTIIQSGMRIPRGQLHEQTVYGAITQFSKNNKGKVFQTKEIVTRYKMGVGSMGYVFSGKETCDVINDKKNKSLVIIDGIEKAINYIVDRHIRDVVRNRLNEAFPENETYRSEAEKALAEGKKYDGKERCQKALDQLRKLSEKPLYADKNKNIIIKSARCYTGLSAVQPLRYNNNHEPISYVLTKNNHHVALYKDENGKFQECIYTFWQVVERSKFKLPLIITDTKALWNEIQQRENKGDTFPDSLIQSLPLPNWTFIESLQLNDMFVMDINDDDFEHYIATNNYEELGKKLYRIQNISSFDYSFRLHTDTTSKTTSDAALSKRYIRIKSIKAYIEHNPHKVKISLLGKIIRNTE

SEQ ID NO: 1257 - protein, 1154 aa, unidentified
  REGION 1..1154: note = Description of Unknown: uncultivated organism with predicted taxonomy: Bacteroidales
  REGION 1..1154: note = MG16-176 effector
MKKKILGLDLGVGSIGWALIETEDNQPQKILGMGSRIVPISKDDNDQFSKGQAITKNADRTARRTTRKGYNRYQMRRALLTQALRNNNMLPERMDENVIDLWKLRSDAATEGHQLTLPQIGRVLYHINQKRGYKHSKADKNGDSKQTKYVEAVNQRFKDIQEIHQTIGQHFYLELLRTRVHRENGDYYTYRIKDQVFPRAAYIAEFDQIMNVQRAYYPEVLTDEFIDTLRNCIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVSPEIEETPLFKLWHAVYSLQNADELAKTLREKFQITDEAVIEALCKIDFVKPGYANKSHKFIRRLLPYLMEGMMYSEACKRININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEESLHQCFYCGKTIDLSEFLNGADVEIEHIIPRSILFDDSFSNKVCACRRCNQEKGNQTAMEYMETKSAAEQETYKQRVDEAFTAKRISKTKRDHLLWRKADIPADFIERQLRQSQYIAVKAVEVLQDGIRQVWTSGGSVTDFLRHQWGYDEILHTLNLPRYRQVEGLTEFVDFEHAGQKHTEERIKNWSKRIDHRHHAIDALTVALTQQGYIQRLNTLEASHDFMEKQVKEAGTKYNEKKSILEKWINEQPHFSVEEVTNAVDGILVSFRAGKRVTTPARRAIYKGGKRVIAQRGIEVPRGALTEETIYGKLGDKFTVKYPLDHPSMKPENIVDPTIRALVQKRVAERGKDAFKDPLYSAEGMKIKSVRCFANVTDNSVVPIKYNGEGQPIGYAKKGNNHHVAIYTDKSGKPQESVVSFWDAVERKRYGVPVVITNPHEVWDNLLNTDFPQEFLAKLPEDDWQYLFSMQENEMFVLGMEDDEFYDAIERQDYASLNKHLYRVQKIRSGEYTFRYHTETKVDDKYEGVANGTNTSFQLGALVSIRGFSSLFAKHPHKVKVDILGHIHKA

SEQ ID NO: 1258 - protein, 1154 aa, unidentified; identical to SEQ ID NO: 1234
  REGION 1..1154: note = Description of Unknown: uncultivated organism with predicted taxonomy: Bacteroidia
  REGION 1..1154: note = MG16-177 effector

SEQ ID NO: 1259 - protein, 1104 aa, unidentified
  REGION 1..1104: note = Description of Unknown: uncultivated organism with predicted taxonomy: Porphyromonas sp. oral taxon 278
  REGION 1..1104: note = MG16-178 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQTKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKALNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKEAGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTET

SEQ ID NO: 1260 - protein, 1217 aa, unidentified; identical to SEQ ID NO: 1219
  REGION 1..1217: note = Description of Unknown: uncultivated organism
  REGION 1..1217: note = MG16-179 effector

SEQ ID NO: 1261 - protein, 1130 aa, unidentified
  REGION 1..1130: note = Description of Unknown: uncultivated organism with predicted taxonomy: Bacteroidales
  REGION 1..1130: note = MG16-180 effector
MKKKILGLDLGVGSIGWALIETENDQPKQIVGMGSRIVPISKDDNDQFSKGQAISKNADRTARRTTRKGYDRYQLRRALLTQVLRQNGMLPERMDENVIDLWKLRSDAATEGLQLTLPQIGRVLYHINQKRGYKHAKADDNGDSKQTKYVEAVNQRYADLQGEKQTIGQHFYLELLRSKVEGASGPYYTFRIKDKVFPRAAYIAEFDQIMRVQRAYYPEILTEELIDTLRNRIIFYQRPLKSCKHLVSLCEFEMRPYKTKDGKIVYSGPKCAPRTSPLAQLCAMWETANNITLTNRNNERYEFSLEERQQIVEHLCTHDALKLTDLYKILGISKKDGWYGGKAIGKGIKGNVTLNQLRKALNGKYGQWLEMPIEHVDVVDNTTAEVFWAVSPKVEETPLFKLWHAVYSLQDAEELAKTLRNKFGITDQEVIDALCKIDFVKPGYANKSHKFIRRLLPYLMEGMQYSEACTRIGINHSNYMTAAERDARPLAERIELLQKNALRQPVIEKILNQMINLVNRLQQEYGPIDEARVELARELKQSREERENAFKRNNQNERLNKEIADKIEEMGIRPSRSRIQKYKMWEESNHRCMYCGKTVSLAEFLNGADVEIEHIIPRSILFDDSFSNKVCACRECNHEKDNMTALDYLETKPAVEVDAYKQRVDEAFKEGRISKTKRDHLLWHKSDIPQDFIDRQLRQSQYIAVKAVEILQQGIRQVWTSGGSVTDCLRHQWGYDEILHTLNLPRYRQVEDLTEIVHYEHAGQEHDEERIKNWSKRIDHRHHAIDALTVALTRQAYITRLNSLNAEFTREEMLKEVEEANTVYNEKKSLLEKWVNEQPHFSVEDVTQSVDGILVSFRAGKRVTTPARRAIYNGGKRTIVQRGLQVPRGALTNEFVYTKNGNKYARKYPINAISNPENIVDPTIRQLIKARLAAFNGNAKEAFKEPLYSAEGMEIRTVRCYNNKLSDRGVVAMKYNERREPIGYAETDNNHHLAIYRDSKGELQESIVSFYEAVKRKIAGLPIMDEHPEPDWNLVQTMQENEMFVLGMNDEDFEKSIANDDYQLLNKHLYRVQSISHDDYYFCLHTESKATDKNECMKLGSILRIRGVNSLQKYNPHKVKIDIMGRITKA

SEQ ID NO: 1262 - protein, 1154 aa, unidentified; identical to SEQ ID NO: 1237
  REGION 1..1154: note = Description of Unknown: uncultivated organism with predicted taxonomy: Bacteroidales
  REGION 1..1154: note = MG16-181 effector

SEQ ID NO: 1263 - protein, 1219 aa, unidentified
  REGION 1..1219: note = Description of Unknown: uncultivated organism with predicted taxonomy: Prevotella
  REGION 1..1219: note = MG16-182 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEKILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMSRKAQGKETEEDKELWENFIDRQLRQSQYIARKSVEMLQQICKNVYFTSGSVTDFVRHQWGYDEILHDLNFERYMKAGLTSMVKQLHSGKEVEVERITNWTKRLDNRHHAVDALAIACTTQGMIQRLNTLNASREGILDELNSKEERVVDPERSMLEKWIYTQPHISYAQAKEAIDNIIISQRPNTRITVPGKRYITKNGKRALVQTGIIVPRGALHAEFVYGRIMKQEADGVTLTPQYVRKYKLGIGAQGFLFNGKEFYKEELKRDSKTGLSSIVVTDKIKDVLEKVVDGGIRHRILERLNRGFEEGADYRANVAQALSNLKNLDEDPIFSDDAKTRPIRTVRKYVSSSTMVAVRKDGNGKPMSFVEPDGNHHVAFYKNEDGTITESIVTKWQAVQRKLNRIPIIIDNPSQTWSEIMGRNDVPEELLQTLPKDKTTFLLSLQIGEAFIMGMDEADFQKAFEEKDMQTLAEHLYFVQSISSSDYRFRRHIEAQYDTNDINKEDKRFLRIRKIQALFEYNPHKAKITVLGD

SEQ ID NO: 1264 - protein, 756 aa, unidentified
  REGION 1..756: note = Description of Unknown: uncultivated organism with predicted taxonomy: Prevotella
  REGION 1..756: note = MG16-183 effector
MKKVLGLDLGVGSIGWCLIEKDDDNTPKRIIRMGSRIVPISSDEESGYTRGNAISKNADRTAKRTSRKCYDRYQLRRQALLNLLKRLGMEPSKKLIFEQNPLELWQKRADAASKEITIEELGRVLLHINQKRGYKHSRLSNSDSKETAYVQEVNSRYDDLKAEGLTIGQHFAAKLKENEQTSADGKKYYTYRIKEQVYPRHAYEEETEQILEVQSRYHADILTPDVCKEIKDIIFYQRDLKSCKNLVSLCEFESYTITKDGKEMTIGPKVAPRTSPLAQLSSILETANNITIRNRRNDELYISPEQRKAIADFLDNHEVMKLTDLYKILNIGRKDGWWAGKAIGKGLKGNTTKCQIREALSNLSKEQIESLTAFKLEYDEYVDAETGEVRKRINNTLAEKQPLYRLWHLLYSIKDVDELSGALRRLGIENEESIQNLCNLDFRTAGYANKSAKAIGRILPYLMDGMMYSDACELAGFDHSRRINPDRVLLTSLPQIQKNELRQPVVEKILNQLVNVVNALLEKEGPIDESRVELARELKQSKDERNEAFRRNNQNERLNKEYAERIKEYGLTPTRNRIMKMKMWEESEYTCMYCGQPVNVTEFLQGADVEREHIIPRGLLFDNSFTNQVCSCRRCNSQKGMRTAYDFIADDKGQEGLDSYIDRINDLFNRKQISRSKFNRLLVSHKAYMNRKAQGKETEEDKELWENFIDRHLRLSPYIARKSVEMLQQICKNVYSTSGSVTDFVRHQWGYDEILH

SEQ ID NO: 1265 - protein, 1154 aa, unidentified
  REGION 1..1154: note = Description of Unknown: uncultivated organism with predicted taxonomy: Bacteroidales
  REGION 1..1154: note = MG16-184 effector
MKKKILGLDLGVGSIGWALIETENDQPKQIIGMGSRIVPISKDDNDQFSKGQAISKNADRTARRTTRKGYDRYQLRRSLLTQVLRQNGMLPERMDENVIDLWKLRSDAASEGHQLTLAQIGRVLYHINQKRGYKHAKADNNGDSKQAKYVEAVNQRYKEIQESKQTIGQHFYLELLRSKVDGVRGPYYTFRIKDKVFPRAAYMDEFDQIMRVQRDYYPDVLTEELIDTLRNRIIFYQRPLKSCKHLVGLCEFEMRPYKTQEGNIVYSGPRCAPRTSPLAQLCAMWESVNNITLTNRNNERYEFSLEERQQIVEHLCTHEVLKITDLYKILDISKKDGWYGGKAIGKGLKGNTTLNQLRKAMNGKYQEWLEMPIERVDDVDNTTAEVFWVVSPKVEETPLFKLWHAVYSLQDTDELAKTLCSKFGITDQEVIEALCKIDFVKPGYANKSHKFIRRLLPYLMKGMMYSEACERIGINHSNSMTAAERNARPLAEHIELLQKNALRQPVIEKILNQMINLVNRLQQEYGPIDEARVELARELKQSREERESAYKAINKNERENAERAAKIAEFGIRPSRSRVQKYKMWEESQHRCFYCGKMVDLAQFLNGADVEIEHIVPRSILFDDSFSNKVCACRECNKEKGNLTAMEYIETKPVGEQEAYKQRVAEAFDAHRISKTKRDHLLWRRADIPQDFIERQLRQSQYIAVKAVEILQKGIRTVWTSGGSVTDFLRHQWGYDEILHTLNLPRYRQVDELTEMVHYEHAGQEHDEERIKNWTKRIDHRHHAIDALTVALTRQSYIQRLNTLEASHDIMEKQVKETGTQYNEKKSILEKWVAEQPHFPVADVTENVDGILVSFRAGKRVTTPARRAIYKGGKRTIVQTGLQVPRGSLTEETVYGRLEDKFVVKYPLDHPSMKPENIVDPTIRALVQKRVEEKGKDAFKEPIYSAEGMEIKSVRCYTSLSENGVVPVKFDEKGQPIGFAKKGNNHHVAIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 1266 - protein, 930 aa, unidentified
  REGION 1..930: note = Description of Unknown: uncultivated organism with predicted taxonomy: Fibrobacter
  REGION 1..930: note = MG16-185 effector
MKKILGLDLGVSSIGWSVISVDKNGDPSEILGMGSRIVPLSTDDANEFSTGNAISKNQKRTQKRTARKGYDRYQLRRENLTAELRKHQMLPDERLIKLPVLDLWTLRANAATEGCKLSLPEIGRVLYHINQKRGYKHAKADEAGDKKQTEYIENVNKRFAMIKELGLTIGQFFANKLKESEVVSEKGTFYTYRTKEQVFPRGAYIAEFDQIIEVQRKFYPQVFTDEFINRLRNEIIFYQRNLKSCKHLVSLCEFEKREYKNKDGKIVFDGPKVAPRTSPLFQICRIWEFVNNIRLDGYKETKALSQDERLKVVDFLDNHEKMTAKDFIKLLGLDKNDEWDLKRYFGKNGVQGNSTKTQLAAALANIPNTSELLRFNLALENSNYVNKSTGEVLKVISSDFQNEPLYMLWHTVYSISDKEELKNALNKKYGITDESVINSLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKRERENEKIEAKIQEFGIRSSRNRIQKYRLWEESEQKCFYCGDTVNVKEFLSGLDVEVEHVIPKSLLFDDSFANKVCACRKCNAAKGNKTAYDFMEGQKKEVFDAYVKRVNDFYKDGKISKTKKERLLTTQSKIPSDFIERQLRQTQYIAKKALEMLKNVCYNVYATSGSITDFIRHIWGYDEILHQLNFERYKKGGLTEFREYDHKGETHTEERIQNWSKRLDHRHHAIDALVIAMTRQSIIQRLNHLNTERDAMFQEVEKQSKEWKNDYSMLQEWLRERKHFSTEDVAKKVSNILVSFKAGKRVATIGKRVKYEHEKKFILQTGIVIPRGPLSEESVYGKIKVLDRNKPLKYLFENPQSIVNTDIKSA

SEQ ID NO: 1267 - protein, 1222 aa, unidentified
  REGION 1..1222: note = Description of Unknown: uncultivated organism with predicted taxonomy: Prevotella
  REGION 1..1222: note = MG16-186 effector
MKKVLGLDLGVGSIGWCLVEKDDKNIPLRIIRMGSRIVPITKEEENGYTRGNAISKNADRTVKRTARKCYDRYQLRRKALVNLLKRCGMMPDKGLILEQSPLDLWQKRADAASKEISLEEVGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDTIFYQRDLKSCKNLVSFCEFESYTIKRNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFNLIFDEYVDEETGELRKRINNSHAEHQPLYRLWHLIYSIKDNDELSIALRSLGIEDEVCIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNKEYAERIKKYELTPTRNRIMKMKMLEESEYKCMYCGQPVKEKEFLQGADVEREHIIPRALLFDNSFTNQVCSCRSCNSQKGMRTAYDFIADDKGQEGLEAYIERINDLFNKKKISRSKLNRLLVSYKAYVSRKAQGKETEEDVQLWENFIDRQLRQSQYIAKKSVEILQQVCKNVYTTSGSVTDFVRHQWGYDEILHDLNFERFKKANLTTMVKQLHSGKEVEVERIKDWTKRLDNRHHAVDALAIACTTQGMIQRLNTLNASRDAMLDELNNKEQRMIDSERSMLEKWIISQPHVSCVEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLDKIVDGGIRKRILERLNRGFEDGTDYRTNTAKALENLKNLDEDPIYSDDAKTRPIRTVRKYVNSSTMVAVRKDDNGKPVSFVVPDDNHHVAFYKDKDGVITESIVTKWQAVQRKLNHIPIIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 1268 - protein, 1155 aa, unidentified
  REGION 1..1155: note = Description of Unknown: uncultivated organism with predicted taxonomy: Bacteroidales
  REGION 1..1155: note = MG16-187 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYRAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1269 - protein, 1222 aa, unidentified
  REGION 1..1222: note = Description of Unknown: uncultivated organism
  REGION 1..1222: note = MG16-188 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYSEACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1270 - protein, 1222 aa, unidentified
  REGION 1..1222: note = Description of Unknown: uncultivated organism
  REGION 1..1222: note = MG16-189 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMLEQTPMELWQKRADAASKEISLEELGRGLLHINQKRGYKHSRLSNSDSKETAYVQEVNSRYDDLKAEELTVGQHFAAKLKENEQISADGKKYYNYRIKEQVYPRHAYEEETKKILEVQSRYHSDVLTPDVCKEMMDIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCQIREALSAHPKEQVDSLIAFQLEFDEYVDEETGEVSKRINNTLAEQQPLYKLWHMLYSIKDNRELSGALQHLGIEDNESIEKLCNLDFRTAGYANKSAKAIGRILPYLMEGVMYREACERAGLDHSRRIDPNRPLLKHLPQIQKNELRQPVVEKILNQLVNIVNALLEKEGAIDEIRVELARELKQSKDERNETFKRNNQNERQNKEYAERIKKYGLTPTRNRIMKLKMWEESEHACMYCEQPVDPIEFLKGSDVEREHIIPRGLLFDNSFTNQVCSCRRCNSKKGMRTAYDFIADDKGQEGLNAYIEHINDLFDKKKISRSKLNRLLVSHKAYISRKAQGKETEEDKDLWENFIDRQLRQSQYIAKKSVEMLQLVCKNVYVTSGSVTDFVRHQWGYDELLHDLNFERFKKAGLTTMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYITKNGKRTLVQTGIIVPRGALHAEFVYGRIMKQKTDGVTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAVRKDDNGKPVAFVEPDGNHHVAFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 1271 - protein, 1224 aa, unidentified
  REGION 1..1224: note = Description of Unknown: uncultivated organism with predicted taxonomy: Prevotella ruminicola
  REGION 1..1224: note = MG16-190 effector
MKKVLGLDLGVGSIGWCLIEKDDNNTPRRILRMGSRIVPISSDEESGYTRGNAISKNADRTAKRTARKCYDRYQLRRQALVNLLKILGMEPNKNLMFEQTPLELWQKRADAASKEITLEELGRVLLHINQKRGYKHSRLSNSDSKETAYVQEVNSRYVVLRAEGLTVGQHFAAKLKENEQESTDGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDEYVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMSRKAQGKETDEDKELWENFIDRQLRQSQYIAKKSVEMLQQVCKNVYTTSGSVTDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1272 - protein, 1155 aa, unidentified
  REGION 1..1155: note = Description of Unknown: uncultivated organism with predicted taxonomy: Labilibaculum filiforme
  REGION 1..1155: note = MG16-191 effector
MKKKILGLDLGVGSIGWALIETEDNQPQKILGMGSRIVPISKDDNDQFSKGQAITKNADRTARRTTRKGYNRYQMRRALLTQVLRNNNMLPERMDENVIDLWKLRSDAATEGHQLTLPQIGRVLYHINQKRGYKHSKADENGDSKQTKYVEAVNQRFKDIQEAHQTIGQHFYLELLRTRVHRENGDYYTYRIKDQVFPRAAYIAEFDQIMSVQRAYYPEVLTDEFIDTLRNRIIFYQRPLKSCKHLVSLCEFEMRPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKRIDVVDATTSEVFWAVNPDVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAAKIAEFGIRPSRSRIQKYKMWEKSLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKADIPSDFIERQLRQSQYIAVKAVEVLQDGIRQVWTSGGSVTDFLRHQWGYDEILHTLNLPRYHQVEGLTEFVDFEHAGQKHTEERIKNWSKRIDNRHHAIDALTVALTQQGYIQRLNTLEASHDFMEKQVKEAGTKYNEKKSILEKWINEQPHFSVEDVTNAVDGILVSFRAGKRVTTPARRAIYKGGKRVIVQRGIEVPRGALTEETIYGKLGDKFTVKYPLDHPSMKPENIVDPTIRALVQKRVAERGKDAFKEPLYSAEGMKIKSVRCYTSLSENGVVPVKYDEAGKPIGYAKKGNNHHIAIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 1273 - protein, 1222 aa, unidentified
  REGION 1..1222: note = Description of Unknown: uncultivated organism with predicted taxonomy: Bacteroidales
  REGION 1..1222: note = MG16-192 effector
MKKVLGLDLGVGSIGWCLIEKDDNNTPKRILRMGSRIVPISSDEETGYTKGNAISKNADRTVKRTARKCYDRYQLRRKALVNLLKRLGMEPNENLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILERLNRGFEEGVDYRVNVAKALANFKNLDDDPVYSDDAMTRPIRTVRKYVSSSTMVAIRMDSNGRPIAFVEPDDNHHVAFYKDEDDEKKEIVVTKLLAVQRKLNHIPIIIDNPSQTWSEVLGRNDVPEELLQSLPKDKSIFLLSLQKGEAIIMGLEEMDYQRAILAKDMRTLCNHLFYVQSASSRDYRFRRHVEVKYDTKDINKDDMRFLRIRTINELFKINPHKVKVTVLGDIIE

SEQ ID NO: 1274 - protein, 1226 aa, unidentified
  REGION 1..1226: note = Description of Unknown: uncultivated organism
  REGION 1..1226: note = MG16-193 effector
MKKILGLDLGVGSIGWSVISVDENGDPSEILGMGSRIVPLSTDDANEFSTGNAISKNQKRTQKRTARKGYDRYQLRRENLTAELRKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAVVPVKKDENGNAIGFVKPGNNHHVAIYKDENGNLQESVVTFWHAVERKKYGLPIVITNPIDAWKLAREQNCPKEFLDSLPNENWIYEQSLQENEMFVMGLDDNMYDKAVAEKNYALLNQHLYRVQKISSSDYYFRYHLETKLDDSASAIEIGKYKRIRSFKAFALAKPHKVKISLLGKLITRV

SEQ ID NO: 1275 - protein, 760 aa, unidentified
  REGION 1..760: note = Description of Unknown: uncultivated organism with predicted taxonomy: Sediminibacterium sp. C3
  REGION 1..760: note = MG16-194 effector
MKKVLGLDLGVGSIGWCLVEKDDNNTPTRILRMGSRIVPISSDEETGYTKGNAISKNADRTAKRTARKCYDRYQLRRKALQEMLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKVSDLYGILNIGRKDGWWAGKAIGKGLKGNTTKCQLREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWDNFIDRQLRLSQYIAKKSVEMLQQVCRNVYSTSGSVTDFVRHQWGYDELLHDLNF

SEQ ID NO: 1276 - protein, 1248 aa, unidentified
  REGION 1..1248: note = Description of Unknown: uncultivated organism with predicted taxonomy: Bacteroides
  REGION 1..1248: note = MG16-195 effector
KMKNILGLDLGTTSIGWALIKTDNNNIPCEIRGMGVRRVPLAENEGDKFAQGQSVTINADRTKARGIRRNNDRYKLRRQALSEKLSSLGIEPNDSLMKLHMMDLWQLRANAATDRVSLPELGRILHHLNKKRGYKHSSKDEDKSMRDFLKNVRERYSELHCLNMTLGQFFAKKLLETAVTKGDKTYYVFRIKDLVFPRKAYEEEYDTIMQCQKKFYPNVLTDEVIDYIRNHIIYYQREPRSCKHLVSVCEFEKRHFYDKEGQLKRNNRNEIIYDGPKVAPRTSPIFQLYITCQSANNIRFHNKKKDYLYITREQRQRIVHFMDTNEKLKLADVKRILEINDKSEWYCDNAIKNGIKGNTTKCAIVNALSSLPQEKIAEITRFHLETEPTKDVDTETGEVLVKIKNNYQHEPLYRLWHIIYSIKKEEERTHAVTKFLQSFGVDNDDIVQKLSNIDFTTPGYGNISAKAICRILPYMMEGIEYSEACEYVGINHSNSLSKEENERRELMCQLPAIKKNSLRQPTVEKILNQTINVFNRINAELSQTGECINEVRVELARELKQSKDERHDTSEVIKALENKNKEYKTFIEKEYKLKATRKNLLRYRLWIESNQSCFYCLKPIKFTPFANESEEEREHILPKALHYDDSFANQVCSCKDCNSTKGGRTAMDYMRTTPYLQHYIDRVNKLYQANKISGKKYSHLLASYDDYQLRKKEGKETKEDILIWEKPIDRQLRLSQYISKKAMEILSFGCRDVVATSGSITAIIRHAWGWDTILEELNIQTYRNANLTEVIEVKSKGQNKKMETIKNWTKRLDNRHHAIDALVVACTSSSIIQRINTLNASKQKMRDEITSARKKWDENNILTQWIREKNPLNRKEVLEHVSSIFISMKAGKKVTVPGKRKEFKHGKAMIKQEGLRIPRGPLHEEGLYGSILIEGKKEIVIRYKLGKGTIGYLFTGKEKCEVKKNGNEYTLKDGIAAILDSIVDKHIRNLVENRLNRIFPDGETYRSEAEKALKEGREYNGEKRCKEALEQLKGLDDDPLFHDKDETRIIKSIRCKTGLNAVRPIRFNDNNEAITYVLPKNNHHVAIYRDENGKFIECVCTFWDAVGRVNQNIPCIISNIEEVWNDIHRREANGEYFSVEFKNTLPKEDWTFVESMQQNEMFVMDMDRETLERNIASGNYSVISQHLYRVQALSAGDYIFRIHTDTKSERTKEANLSKRFIRLSLKKFVASEHQKVQLSILGGITIAQ

SEQ ID NO: 1277 - protein, 891 aa, unidentified
  REGION 1..891: note = Description of Unknown: uncultivated organism with predicted taxonomy: Gammaproteobacteria bacterium
  REGION 1..891: note = MG16-196 effector
MKKVLGLDLGVGSIGWCLIEKDDNNTPKRILRMGSRIVPISSDEETGYTKGNAISKNADRTAKRTARKCYDRYQLRRKALVNLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIDENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNSQNERENKEYAERIKEYGLTPTRNRIMKMRMWEESEYTCMYCGQPVNVVEFLKGADVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILLQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKR

SEQ ID NO: 1278 - protein, 1250 aa, unidentified
  REGION 1..1250: note = Description of Unknown: uncultivated organism with predicted taxonomy: Bacteroides
  REGION 1..1250: note = MG16-197 effector
MKNILGLDLGTTSVGWALIKAEDNNTPVEIQGMGVRIVPLAENEGDKFTRGQDVTVNADRTTARGIRRNYDRYQLRRQALTEKLRQLNMLPDENLIKLPVLELWQLRANAAKEKVTLSELGRVLYHLNQKRGYKHSQADKKDSKQRAYVKEINSRYTELNSLGMTIGQFFAQKLEETAVTHDGKTLFVYRIKDQIYPRQAYEEEYDIIMKCQQGFYPDILTDEVIDEIKNRIIYYQRDLRSCKHLVSICEFEKRCFYDAEGNVKRNEKGEIIYDGPKVAPRTSPLFQIFKNWQSINNIRFHNRRNEYLFISKEQRQVIAGVMDNAETLKLKDVQSVLGLTSKSGWYCDKAMKSGIKGNTTKCAILSALSSLPDSTIKDITRFNLETEETKNVDEETGEILLRIKNTYLDEPLYRLWHIIYSIKNVDERFNAIAKFLKEFNVEDASVVNALNDIDFVTPGYANLSSKAMCKMLPYLMDGLDYSDSCEYVGYNHSGSLTKEENANRELLNQIPALKKGELRQPTVEKILNQTINVFNQLSARLEKRGERIDEVRVELARELKQSKDERKEASDGIRKQQKRNEEYAKMLVEEGVRPTRNRILRYRLWEESNKRCFYCGQPISFNEFIKSSDAEREHVIPKALMFDDSFANQVCSCRECNKEKGGRTALDYMRTKSNLQAYLDRVDDMYQSHQIGGKKHSHLLASYDDYLSRKKEGKETKEDIMIWETPIERQLRLSQYISKKAQEILKTACREVVATSGTITDLIRHTWGYDTILHELNFPNYKEAGLTSFVTDEKTNQQREVIKDWSKRLDHRHHAVDALAVACTSRSIVQHINTLHASRDEMRKEVNSARKDWKDNNLLQQWIMEKKPFDRQYVLHKVASILVSMKAGKRTTVPGKRKVYKNGKPITIQTGLRIPRGQLHEQTIYGAIKQYDKDGKETTKIVTRYKVEDIFKGKETCDVVLDKKTNQYYINDEIEKALSYVVDKHIRDVIKERLNEAFPDGETYRSEAEKALVEGKPYKGENRCKQAFEQLKTLDEHPLYADKNKSIVIKKVRCYTGLSAVQPLRYNNNNDPISYVLTKNNHHVAIYADENGKYKECIYTFWQAVERSKYRLPLIIKDPKALWDEITQRENNGENFPDSLIKSLPMRDWTFIESLQSNDMFVMDMDDNDFEICISTNNYEELGKHIYRIQSISTLDYFFRLHTDTTSTTTPEAALSKRFIRIKSFKSYIAHNPHKIQVSLLGKIFTNQND

SEQ ID NO: 1279 - protein, 818 aa, unidentified
  REGION 1..818: note = Description of Unknown: uncultivated organism with predicted taxonomy: Bacteroidales
  REGION 1..818: note = MG16-198 effector
MKKVLGLDLGVGSIGWCLIEKDDNNTPKRILRMGSRIVPISSDEETGYTKGNAISKNADRTAKRTARKCYDRYQLRRQALVNLLKRLGMEPNKNLMFEQTPIELWQKRADAASKEVSLEELGRVLLHINQKRGYKHSRISNSDIKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYINRKALGKETDEDKELWENFIDRQLRQSQYIAKKSVDMLQQVCKNVYTTSGSVTDFVRHQWGYDELLHELNFERFKKAGLTAMVKQLHSGKEIEVERIKDWTKRLDNRHHAVDALAIACTTQGMIQRLNT

SEQ ID NO: 1280 - protein, 988 aa, unidentified
  REGION 1..988: note = Description of Unknown: uncultivated organism with predicted taxonomy: Gammaproteobacteria bacterium
  REGION 1..988: note = MG16-199 effector
MKKVLGLDLGVGSIGWCLIEKDDNNTPKRILRMGSRIVPISSDEETGYTKGNAISKNADRTAKRTARKCYDRYQLRRKALVSLLKRLGMEPNENLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQLREALSGLPKEQVDSLTAFNLEIYENVDEETGEVRKRINNTQAEQQPLYKLWHMLYSIKDNKELAGALNHLGIEDEESIEKLCKLDFRTAGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVDMLQQVCKNVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSKIVVTDKIKDVLDKIVDGDIRQRILE

SEQ ID NO: 1281 - protein, 1233 aa, unidentified
  REGION 1..1233: note = Description of Unknown: uncultivated organism with predicted taxonomy: Fibrobacter
  REGION 1..1233: note = MG16-200 effector
MKKILGLDLGVGSIGWSVISVDENGDPSEILGMGSRIVPLSTDDANEFSTGNAISKNQKRTQKRTTRKGYDRYQLRRENLTAELRKHQMLPDEHLIKLPVLDLWTLRANAATEGQKLSLPEIGRVLYHINQKRGYKHAKADEAGEKKQTEYVENVNKRFAMIKDLGLTIGQFFARKLKESEVVSEKGKFYTYRTKEQVFPRGAYIAEFDQIIEVQRKFYPQVFTDEFINRLRNEIIFYQRNLKSCKHLVSLCEFEKHEYTNKDGKIVFDGPKVAPRTSPLFQICRIWEFVNNIRLENGYKEARTLSQDERLKVVDFLDNHEKMTAKDFTKLLGLNKNDEWDLKRYFGKNGTQGNTSKTQLATALANVPNASELLQFNLTLENSNYVNEKTGEVLKVVSSDFQNEPLYMLWHTVYSLSDKEELKNALNKKYGITDESVINNLFKIDFVKPGFGNKSAKAIRRILPFLQEGLVYSDACAEAGYNHSDSLTKSENEARTLLARLPQIKKNELRQPVIEKILNQMVNVVNAIYDEYGQIDEIRVELARELKQSKDERNTTASNIAKKERENKNIEAKIQEFGIRSSRNRIQKYRLWEESEQKCFYCGQPVQAKEFLSGLDVEVEHIIPKSLLFDDSFANKVCACRKCNADKGNKTAYDFMKGQKTEVFDAYVKRVNDFYKDGKISKTKKERLLTTQSEIPSDFIERQLRQTQYIAKKALEMLKDVCYNVYATSGSVTDFIRHTWGYDEILHQLNFDRYKKGGLTELREYDHKGETHTEERIQDWSKRLDHRHHAIDALVIAMTRQSIIQRLNHLNTERDAMFQEVEKQSKEWKNDYSMLQEWLRERKHFSTEDVAKKVSDILVSFKAGKRVATIGKRVKYEHGKKKVLQTGVVIPRGPLSEESVYGKIKVLDRNKPLKYLFENPQSIANADIKFAVTNRLAQYEHDVKKAVQSLKKSPIVLANGKNLENADCYKEEYVIKYSLNGFKAKDIDSVVDSHIKDVLYKRLEEYDGNEKEAFKDIEDNPIYADDAHKIKIRNVRCFTGLSAVVPVKKDENGNAISFVKPGNNHHVAIYKDENGTLQESVVTFWHAVERKKYGLPIIVTKPAEAWKLAIEKNCPKEFLDCLPKENWTFVESLQVNEMFVIGMNDEEFGNAIVDKDYALLNQHLYRVQKITTKEYCFRLHTETKVDDKYKGVKDAMKSKAMGKLKMIQSMDSWQKANPHKVKISLLGKLITRE

SEQ ID NO: 1282 - protein, 1242 aa, unidentified
  REGION 1..1242: note = Description of Unknown: uncultivated organism with predicted taxonomy: Prevotella
  REGION 1..1242: note = MG16-201 effector
MKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAKIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIDQRQAMVDFLDTHEKLTLSDMYSILGISKKDGWWGGKAIGRGLQGNTTKIALKKALGDFANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKTATIGKRIEYKHGNKHIVQKGIIIPRGALHEEGVYGRIEINGKKEIVKKYKLGKGAQGFVFTGKETYAEKINKKTGGIQIEDKIKNVLDSIVDSNIRAKVLQRLNQGFEEGQDYRNNVKKALDNLNNLDENPIFADKNNTIPIRTVRCRTGLSAVVPIKKDERGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDKEYDLISNYLYRVQSISESDYWFRLHLETQNDKTTSAKLAKKYYRTKSIKGFYSLNPHKVYISVIGKIKEL

SEQ ID NO: 1283 - protein, 1155 aa, unidentified
  REGION 1..1155: note = Description of Unknown: uncultivated organism
  REGION 1..1155: note = MG16-202 effector
MNKKILGLDLGVGSIGWALIKTEDDMPKEIIGMGSRIVPLSKDDNDQFSKGQAITKNADRTARRTARKGYDRYQLRRALLTQVLRQNGMLPERMDEQVLDLWQLRSDAATEGCQLTLPQIGRVLYHINQKRGYKHAKSDDNGDSKQTKYVEAVNNRYADLQAAHQTIGQHFYEELYRSRVEREKGFYYTYRIKDQVFPRAAYIAEFDQIMHVQKAFYPDVLTDELIDTLRNRIIFYQRPLKSCKHLVSLCEFEMRPYKTKDGKVVYGGPKCAPRTSPLAQLCAMWETANNITLTNRNNEQLLISPEQRKQIVDFLCSHDVLKLTDLYKILGINKKDGWYGGKAIGKGIKGNATLNQLRAALNGKHAEWLEMPIEIEDKVDEVTGEVVKMVQSSVEQTPLFQLWHAVYSLQNADELAKTLREKFGIAEQEIINALCKIDFVKPGYANKSHKFIRRILPYLMDGYMYSEACEKVGIRHSNSMTVAERNTRSLRARIELLTKNSLRQPVVEKILNQMINLVNRLQQEYGTIDEARVELARELKQSRDERESAYKAMGQNERRNKEIAAKIAEFGIRPSRSRIQKYKMWEESQHRCFYCGEMMDLTQFLNGADVEIEHIIPRSILFDDSYSNKVCACRRCNQEKGNMTAMEYMEAKPSAEFEAYKQRVDDVFNKDHRISKTKRDHLLWRRADIPQDFIDRQLRQSQYIAKKAVEILKDGIREVWTSGGSVTDFLRHQWGYDEILHTLNLPRYQQVEGLTETIQYEHAGQTHEEERIKNWTKRIDHRHHAIDALTVALTQQAYIQRLNTLEASHDHMQKVVNEAGTQYNEKKSLLEKWVAEQPHFSVADVTDKVDGILVSFRAGKRVTTPARRAIYQGGKRTIVQTGIQVPRGALTEETVYGKLGDKFIVKYPLDHPSMKPENIVDPTIRALVQRRVAEKGKEAFNEPLCSAEGMKIKSVRCFTSLSEKGVVPVKHNEAGEPIGYAKKGNNHHIAIYQDKKGEYHEMVVSFWDAVERKKYGVPVVIEHPHELWDSLLDKELPQEFLAKLPLDDWQFILSMQENEMFVLGMEEDEFNDAIERQEYNTLNKHLYRVQKISHADYTFRYHTETKVDDKYEGIEKGRDTSLKLGALVSIRSFGSLFTKFPHKVKIDIMGRITRT

SEQ ID NO: 1284 - protein, 1003 aa, unidentified
  REGION 1..1003: note = Description of Unknown: uncultivated organism with predicted taxonomy: Bacteroides sp. CAG:144
  REGION 1..1003: note = MG16-203 effector
MKNILGLDLGTTSVGWALIQADDNNHPIAISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKNSGKTIGQLFAQKLSETAVSHDGKTFYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNEYLYITKEQKQQMVNIMDHQEVLKLKDVHGVLGLSAKSGWYCDKSIKSGIKGNTTKLAILNALSSLPAENTKELTRFHLEFEETSLVDEETGEIIVQIKNNYLDEPLYRLWHIIYSIKDDAERYNAIVRFLAEFHVDAPDVAHSLKDIDFVTPGYANLSAKAICKILPYMMEGVGYSEACEFVGYNHSGSVTKAENDARELLEHIPAIKKNELRQPTVEKILNQMINVFNRINDNLKSNGERIDEVRIELARELKQSKEERDETSKGISKQQKLNDEYANLLKESGIRPTRNKITRYRLWREANETCFYCGQPVNFNEFVKFSEAEREHIIPKSLILDDSFANQVCSCRKCNAEKGGRTAIDYMRTTPYLQAYLTKVDEMFQGHKISGKKHAHLLASYEDYLVRKQQGKETKEDVNIWEAPIDRQLRLSQYITKKAHELLRTACRDVLATSGSITDLTRHVWGYDTILHELNLPRYKSAGITEVITDERTGREQEVIRDWNKRLDHRHHAIDALAVACTSRSMIQRINTLHASREEMREEVSSPRKDWKENDLLRQWIKEQRPFERQYVLHKVESILVSMKAGKKATVPGKRKVFKNGKPVVVQSGLRIPRGQLHEQTVYGAITLYDKTPEGRREIVARYKMGVGSVGFVFSGKESCDVVFDKKKEQYVLVDGIEKAINYIVDRHIRDIVRERLNEAF

SEQ ID NO: 1285 - protein, 1222 aa, unidentified
  REGION 1..1222: note = Description of Unknown: uncultivated organism with predicted taxonomy: Bacteroidales
  REGION 1..1222: note = MG16-204 effector
MKKVLGLDLGVGSIGWCLIEKDDNNTPKRILRMGSRIVPISSDEESGYTKGNAISKNADRTAKRTARKCYDRYQLRRQALVNLLKRLGMEPSKNLMLEQTPMELWQKRADAASKEISLEELGRVFLHINQKRGYKHSRLSNSDSKETAYVQEVNSRYDDLKAEGLTVGQHFAAKLKENEQETADGKKYYNYRIKEQVYPRHAYEEEVKKILEVQSRYHSDVLTPDVCKEILDIIFYQRDLKSCKNLVSLCEFESYTITKDGKEITIGPKVAPRTSPLAQLSSILETANNITIRNRRNDELYISPEQRRAIAEFLDNHEVMKLTDLYKMLNIGRKDGWWAGKAIGKGLKGNTTKCQIREALSALPKEQVDSLTAFQLEFDEYVDEETGEVRKRINNTLAEQQPLYKLWHMLYSIKDNDELSGALRHLGIEDEESIDKLCKCDFRTAGYANKSAKAIGRILPYLMEGVMYSDACERAGFDHSRRINSDRTLLTHLPQIQKNELRQPVVEKILNQLVNIVNALLEKEGAIDEIRVELARELKQSKDERNEAFRRNNQNERLNKELAERIKKYGLTPTRNRIMKLKMWEESEHSCMYCKQPVDPVEFLKGADVEREHIIPRALLFDNSFTNQVCSCRRCNSKKGMRTAYDFIADEKGQEGLNAYIEHINDLFDKKKISRSKLNRLLVSHKAYISRKAQGKETDEDKELWENFIDRQLRQSQYIAKKSVEMLQLVCKNVYTTSGSVTDFVRHQWGYDELLHELNFERFKKAGLTAMVKQMHSGKEIEVERIKDWTKRLDNRHHAVDALAIACTTQGMIQRLNTLNASREEMLEELSINDQRLIDPERSMLEKWLFVQPHISYAEAKNEINKIVISQRPNTRITVPGKRYVIKNGKRTLAQTGIIVPRGALHAEFVYGQIMKQEADGVTKTLQYVRKYKLGIGAQGFLFNGKEFYKEELKKDSKTGLSSIVVTDKIKDVLEKIVDGGIRQRILERLNRGFEEGADYRANVAQALANLKNLDEDPIYSDDAKTRPIRTVRKYVSSSTMVAVRKDGNGKPMSFVEPDGNHHVAFYKDENGVITESIVTKWLAVQRKLNHIPIIIDNPSQTWCEVLERNDVPEELLQSLPKDNSTFLLSLQIGEAFIMGMEDADYQKALLAKDVRTLCDHLFYVQNASSHDYRFRRHVEAKYDTNDMNKDDMRFLRIRTIDDLFNNNPHKVKVTVLGVIVE

SEQ ID NO: 1286 - protein, 1233 aa, unidentified; identical to SEQ ID NO: 1281
  REGION 1..1233: note = Description of Unknown: uncultivated organism with predicted taxonomy: Fibrobacter
  REGION 1..1233: note = MG16-205 effector

SEQ ID NO: 1287 - protein, 1011 aa, unidentified
  REGION 1..1011: note = Description of Unknown: uncultivated organism with predicted taxonomy: Gammaproteobacteria bacterium
  REGION 1..1011: note = MG16-206 effector
MKKVLGLDLGVGSIGWCLIEKDDNNTPKRILRMGSRIVPISSDEETGYTKGNAISKNADRTVKRTARKCYDRYQLRRKALVNLLKRLGMEPNKNLMFEQTPIELWQKRADAASKEVSLEELGRVLLHINQKRGYKHSRISNSDSKETAYVQEVNSRYDDLKAEGLTIGQHFAAKLKENEQETADGKKYYNYRIKEQVYPRHAYEEEVKQILEVQSQYNPDVLSSDVCKEIMDIIFYQRDLKSCKNLVSLCEFESYTITKDGKVINIGPKVAPRTSPLAQLSSILETANNITIRNRKNDELYISPEQRKAIADFLDNHEVMKLTDLYNILNIGRKDGWWAGKAIGKGLKGNTTKCQIREALSGLPKEQVDSLTAFHLEIDEYVDEETGEVRKRINNTQAEQQPLYKLWHMLYSIKDNNELAGALNHLGIEDEESIEKLCKLDFRTVGYANKSAKAIGRILPYLMEGMMYSEACELAGFDHSRRINPDRVLLTHLPQIQKNELRQPVVEKILNQLVNIVNALLENEGAIDEIRVELARELKQSKDERNEAFKRNNQNERLNKELAERIMKYGLTPTRNRILKLKMWEESEHSCMYCGQPVDPVEFLKGVDVEREHIIPRGLLFDNSFTNQVCSCRRCNSKKGMRTAYDFIADDKGQEGLDTYIDRINDLFNRKKISRSKFNRLLASHKAYISRKSQGKETDEDKELWENFIDRQLRQSQYIAKKSVEILQQVCKDVYTTSGSVTDFVRHQWGYDELLHELNFERFKKAGLTAMVKQLHSGKEVEVERIKDWTKRLDNRHHAVDALAIACTTQGMIQRLNTLNASRDVILEELNSNDQRLVDPDRSMLEKWIYVQPHISYAEAKNEVDKIVISQRPNTRITVPGKRYVTKNGKRTLAQTGIIVPRGALHAEFVYGRIMRQEADGVTMTPQYVRKYKLGIGAQGFLFKGDEVYKEEVKKNSKTGLSIIVVTDKIKDVLDKIVDGDIRQRILERLNRGFEEGVDYRANVPQALANL

SEQ ID NO: 1288 - protein, 957 aa, unidentified
  REGION 1..957: note = Description of Unknown: uncultivated organism
  REGION 1..957: note = MG16-207 effector
MKNILGLDLGTTSVGWALIQSDDNNHPITISDMGVRIVPLAENEGDKFTKGQDITVNADRTRARGIRRNYDRFQLRRNALTEKLRQLNMLPDEHLIKLPVLELWSLRANAVSQKVTLNELGRVLYHINQKRGYKHSRTDGTDSKQRAYVKDINDRYAELKSSGMTIGQLFAQKLSETAVSHDGKTLYVFRIKDQIFPRKAYEEEYDAVMKCQQQYYPQILTNEVIDEIRNRIIFYQRELRSCKHLVSVCEFEKRCFYDANHNVLRNNKGEVVYSGPKVAPRTSPLFQVFKNWQAVNNIRFHNRRNESLYITKEQKQQMVDIMDRQEVLKLKDVHEVLGLTAKSGWYCDKSIKSGIKGNTTKLAILNALSPLPAEKTKELTRFHLEFEETSLVDEETGEIIVRIKNNYLDEPLYRLWHIIYSIKDDAERYNAIVRFLAEFHVDAPEVANSLKDIDFVTPGYANLSAKAICKILPYMMEGVGYSDACEFVGYNHSGSMTKAENDARELLEHIPAIKKNELRQPTVEKILNQMINVFNRINDNLKSNGERIDEVRIELARELKQSKEERDETSKGISKQQKLNDEYANLLKGKGIRPTRNKITRYRLLMESNETCFYCGQPVNFNEFVKFSEAEREHIIPKSLILDDSFANQVCSCRKCNAEKGGRTAIDYMRTTPHLQAFLSKVDEMFQGHKISGKKHAHLLASYEDYLVRKKQGKETKEDVNIWETPIDRQLRLSQYITKKAHELLRTACRDVLATSGSITDLTRHVWGYDTILHELNLPRYKSAGITEVITDERTGREQEVIKDWNKRLDHRHHAIDALAVACTSRSMIQRINTLHASREEMREEVSSPRRDWKENDLLRQWIKEQLPFERQYVLHKVESILVSMKAGKKATVPGKRKVFKNGKPVVVQSGLRIPRGQLHEQTVYGAITLYDKAPEGRREIVARYKMGVGSVGFVFL

SEQ ID NO: 1289 - protein, 1234 aa, unidentified
  REGION 1..1234: note = Description of Unknown: uncultivated organism
  REGION 1..1234: note = MG16-208 effector
MYLCSRKTNKTLYNMKKVLGLDLGVSSIGWALITKDNNNQPIDILKIGSRTVPLLDGEEEGFSNGNGISANSSRTQKRTARKCNNRYKLRREKLTDGLRALNMLPNAMLFNLNPLELWQLRAKAVTDKVSLPELGRILFHLNQKRGYKHSKDNEQDSKQTEYVATINKRYIDLQEKGLTIGQYFAQKLKESEKIQENGVCYTYRIKDQVYPRAAYEEECHKILLNQQRFYPEVLTDDVIKDFFNFIYYQRPLKSCKHLVSRCELEKQLLSSDDDVANYAPKVAPLSSPLAQLDKIWEAVNNFTIRDKRNDELFITLEQRKEIVNYLQEHLTINRSKMREILGISKTKRWFIKADNLRVLQGNKTRIKIAEALSKGDLSQEEINGYLRFDLGYDCQVDTQTGEIAATIIKATFEEQPLYQLWHYIYSIPEERDLKNKLMKFGIHDETVLDALCGISFKTIGYAKKSTRAIRKILPYLAEGFKYSEACYLAGYNHSNSITKDEEANRKLKEYIPQIQKNELRQPVVEKILNQMINIVNSLLKDGPINEIRVELARELKQSKDEREKTSKDIRANKKKNDECAERVKEYGFSPTRNRIMRYKMWVETNHRCIYCNDGVNVKDFLSGVDVEREHIIPKALLFDDSFSNQTCSCRKCNRDKGSRTALDYIRDCGREEEYITRVNELLEKRQISKTKYNHLLTSYRDYLERKTQGKETQEDKDLWEHFIDRQLRQSQMIARKSFEVLRQICHNVYATSGSVTDFLRHQWGYDNILHDLNFERFSKSDNIEEITIVGRDGIETKVKRIKGWNKRIDNRHHAVDALTIALTTQSMIQRLNTLYASRDAMHGDIEASKQKFNEKKSILEKWTAIQPHFTYSQASEAISRILISQRGGKRITTPGKRYEFKGGKKILKQTGIVVPRTALHDEFIYGQISRYDAKGLLTKEIVRKYGIFGGMGCLFTGKETYKEETVSDKKTGISTIKISDGIKDVLDKIVDGGVRKRILERLNRGFEEGKDYRSDTKKALDNLRHLDEDPIFLDDARTIPIKTVRKFTHSTKAIPLRYNDSHQPIAFVEPGGNHHVALYKAPDGTIKEHICTNWHAVQRRLFGLPAIIDKPSEIWVKALENDKFPEDLLSHLPEENLNFIVSLQIGDAFILGMEEEEYQQAISNNNYKLLSEKMYYIQNLSSLNYRFRRHVEAQFDTHQMNKEDLRFYNIKSIGAFFNLNPHRVNVSLIGEIIV

SEQ ID NO: 1290 - protein, 911 aa, unidentified
  REGION 1..911: note = Description of Unknown: uncultivated organism with predicted taxonomy: Chryseobacterium vrystaatense
  REGION 1..911: note = MG16-209 effector
NLTIMKRILGLDLGTNSIGWAVVNTDENDKPVSIENMGSRIVPLTSDDTNEFTKGNAITKNQARTVKRTARKGYDRYQLRREHLTAELRKLKMLPDERLIKLPVLELWELRGRAASKGNQLTLSEIGRVLYHINQKRGYKHAKSDESADTKQKAYVAEVNARYAMIKERNQTIGQFFAEKLKENEIETSKGKFYTYRIKEQVFPRKAYEAEFDQIMECQKEFYPDILTNEEINRLRNEIIFYQRRLKSCKHLVSFCDFEKREYINKVGKVVYGGPKVAPKSSPLFQICKIWEEVNNLTLKNRKNDELFITIEQRQAMVDFLDTHEKLTLNDMYSILGISKKDGWWGGKAIGRGLQGNTTKIALKKALGDIANADNLLQFNLKQTDSNLVDEVTGEILQVIDPKLEKEPLYDLWHTIYSISDKEELANALKKKYNIHDEDIINRLYAIDFVKSGFGNKSTKAMRRILPYLQQGLKYSDACEYAGFRHSDSLTKAENEARQLLEKLPPVQKNALHQPIVEKILNQMINVVNALMIEYGQFASIRVELARELKQSKDERNTTFLQNEAMQKLNESIATRLSSEGIKPTKRTIEKYKFIFPTKGCIDNRTGKFVTKNFDNLLTVNQCIYCGQPFSLSAALNGDGYEIEHIIPRDLICDNSQNNKVLSCRNCNSKKSNRTAFDFMRSQDNATFEAYLERVELWYQKGIISPAKRERLLLSYEDYLERKKKGKITDIDKKYWEDFVSRQAGETQYISREAIRILKQCCRYVNATSGSITATLRHLWGYDEILHQLNFERYKQAGLTEIVTWESNHGKNKHSKEQIVDWSKRIDHRHHAIDALVVACTQQGFIQRINTLNADETKDLMKKQIEASGIKYEEKKVLLDKYLTSLIPFKTQIVADAVNKILVSFKAGKKT

SEQ ID NO: 1291 - protein, 1152 aa, unidentified
  REGION 1..1152: note = Description of Unknown: uncultivated organism
  REGION 1..1152: note = MG16-210 effector
MKKILGLDLGVASIGWALIEADEQNAPKSILAMGSRIVPLSTDDATEFSQGKAISKNRNRTQKRTQRKGYDRYQMRRAALTEELRAHHMLPDEILIKLPVLELWQLRADAATRQLTLPEIGRVLYHINQKRGYRHAKSDSDEEKAQRDYVQAVNDRYAELKAEGKTIGQHFADKLKENCIITEKGPFYTYRIKEQVYPRAAYMEEFDLVIACQKEFYPEVFTDAFINRLRNEIIFYQRSLKSCKHLINQCEFSQRAYKKADGSIVIAGPKVAPRTSPLFQICKIWESVNNLKLTNRKGEEYPFTLSQRKELVEFLDEHEKLTLTDLYKIIGVKKNDGWWGGKAIGKGLQGNTTKCLIKKALGDKYADLLRFDLHIIESKNIDTETGEVLEIISPGLEKEPLFRLWHILYSMQDKDEMAAALHRQFGITEEDIIDALYKIDFVKPGYGNKSSRFMREILPYLQKGMMYSDACNYIGINHSNSITSEENAVRELKSRLPQLQKNELRQPVIEKVLNQMVNVVNALLDKYGEIDEIRVELARELKQSKDERNEVFLRNNKRERENAEIIKRIEEYGVRPSRSRIQKYRLWEESNQICFYCGNTVGVKEFLSGVDAEIEHIIPRSLFFDDSFSNKVCACRACNQEKGNRTAYDYMQSKSEIEFDNYLRRVENYYNEKKISKTKRERLLTAAKDIPQDFLDRQLRQSQYISKKAIEMLKQICRYVWATSGSVTDFIRHNWGYDKILHDLNFERYKSGGLTEMVHYDHQGQEHDEERIKEWTKRLDHRHHALDALTIASTQQGYIQRLNHLNTERDQMFAELEMQREEYKGRYSLLEEWIKERPHISVEDAKVAVDQIAVSFKAGKKVATPGKRYIYKSGKRILAQDGILVPRGALSEESVYGSISTIERNVPAKNLFEHPERIFKGYIRKLVEERIAECGGDWKKARASINKRPIFLDDEGQKKLEYATCWKEESVFHYPIKSIKKNDVDWIVDGHIREIIRKRIEEVGEKNAFNEPIYADKACNIPIRHVRMFTGLSAVEPIKYVDGQPVGFVKPGNNHHIAIYVDTQGNKVEQAVTFWHALERKKYGFPVIIDDTDTVWEKVDQMDLPEAFIKNLPEPGLKLYTSLQQNEMFILGMGEDEYNDAVAAKDYKSLCK

SEQ ID NO: 1292 - protein, 1242 aa, unidentified
  REGION 1..1242: note = Description of Unknown: uncultivated organism with predicted taxonomy: Prevotella
  REGION 1..1242: note = MG16-211 effector
MKKILGLDLGTNSIGWAVVNTDDNGIPTHIEGMGSRIVPLSPDDTNEFTKGNAITKNQSRTEKRTARKRYDRYQLRRENLTAELRKLKMLPDEKLIKLSVLELWELRGKAASKGNQLTLSEIGRILYHINQKRGYKHAKSDENADTKQKAYVAEVNARYAMIKERNQTIGQFFAEKLKENEIETPKGKFYTYRIKDQVFPRKAYEAEFDQIMECQKEFYPEILTEKVINKLRNEIIFYQRKLKSCKHLVSICDFEKQEYINKDGKSIYRGPKVAPKSSPLFQICKIWEEVNNLSLKNRKNDELFITLEQRQAMVNFLETHEKLTLSDMYSILGISKQDGWWGGKAIGKGLKGNVTKIALKNALGDFENADRLLQFNLKQIDSNLVDEVTGEILQVIDPKMEKEPLYDLWHTIYSISDKEELANALKKKYNIHDEDVINRLYSIDFVKSGFGNKSSKAMRRILPYLQQGLKYSDACEYAGFRHSDSLTKAENDARQLLEKLPPIQKNTLRQPIVEKILNQMINVVNALMIEYGQFDSIRVELARELKQSKDERNTTFLQNEAMQRLNESIAKRLSFEDIKPTKRTIEKYKFIFPTKGCIDKRTGKFVTKSFDGLSTINQCIYCGQPFSLSAALNGDGYEIEHIIPRDLLCDNSQNNKVLSCRKCNSRKSNKTAFDFMRSQDESIFEEYLERIELWYKNGIISPTKREHLLLSHEDYLERKKKGKVTDIDKKYWEDFVSRQVGETQYISRESIRILKQCCRTVNATSGKITAILRHLWGYDEILHQLNFERYKKAGLTETKTWESNHGKNKHSKEQIVDWSKRIDHRHHAIDALVVACTQQGVIQRINTLNADETKDLMKKQIESANIKYEEKKVLLDKYLTSLVPFNTKTVAEAVNKILVSFKAGKKTATVGKRIEYKHGKKHIVQKGIIIPRGALHEEGVYGKIEINGKKEIVKKYKLGKGAQGFVFTGKETYAEKVNKKTGAIQIEDKIKDVLDSIVDGNIRAKILQRLNRGFVEGEDYRNNVKQALDNLNNLDENPIFADDNNNIPIRTVRCRTGLSAVEIIKRNEGGEAIGFVKPGNNHHIAIYRDKEGKLKEHAVTFWHAVERKKYGIPVVIENPLEVWDSIRDKQLPETFLEKLPDINWTFEMSLQQNEMFVLGMEDDTFENAMRDNDYAKLGQYIYKVQNISEKQYRFSLHTATKFDVKRMNKTDKSFYNIRSLDALFALHPHKVYISVIGKIKEL

SEQ ID NO: 1293 - protein, 1224 aa, unidentified; identical to SEQ ID NO: 1243
  REGION 1..1224: note = Description of Unknown: uncultivated organism with predicted taxonomy: Prevotella ihumii
  REGION 1..1224: note = MG16-212 effector

SEQ ID NO: 1294 - protein, 1217 aa, unidentified
  REGION 1..1217: note = Description of Unknown: uncultivated organism with predicted taxonomy: Treponema pedis
  REGION 1..1217: note = MG16-213 effector
MKKILGLDLGVASVGWALIEADEQNAPKSILAMGSRIVPLSTDDATEFSQGKAISKNRNRTQKRTQRKGYDRYQMRRAALTEELRANDMLPDETLIKLPVLELWQLRADAVTRQLTLPEIGRVLYHINQKRGYRHAKSDSEEEKSQRDYVQAINDRYAELKAEGKTIGQHFADKLKENCIITEKGPFYTYRIKEQVYPRAAYMEEFDRVISCQKGFYPTVFTDAFINRLRNEIIFYQRNLKSCKHLINQCEFSQRAYKKADGSIVIAGPKVAPRTSPLFQICKIWECVNNLRLTNRKGEEYPFTLEQRKELVDFLDNHEKLTLSDLYKILGIRKSDGWYGGKAIGKGLQGNTTKCLIKKALGDKYADLLRFDLQTIGSKSIDTETGEVLEIISPELEKEPLFRLWHILYSMQDKDEMAAALQRQFGITEGDIIDALYKIDFVKPGYGNKSSRFMREILPYLQKGMMYSDACNYIGINHSNSVTSEENAVRELKSRLPQLQKNELRQPVIEKVLNQMVNVVNALLDKYGEIDEIRVELARELKQSKDERNEVFLRNNKRERENAEITKRIEEYGIRPSRSRIQKYRLWEESNHICFYCGQPVGAKEFLSGVDVEIEHIIPRSLFFDDSFSNKVCACRKCNQDKGNSTAFDFMKAKPEVEFDNYLRRVESYYNEKRISKTKRDRLLTAAKDIPEDFINRQLRQSQYISKKAVEMLKQVCRYVWTTSGSVTDFLRQTWGYNNILHDLNFERYKSGGLTEIRQYDHKGQEQSKECIIGWTKRLDHRHHALDALTIASTQQGYIQRLNHLNTERDEMFAELKKQSEEHKEKHSLLEDWMKERPHLSVEAVKEAVDQIAVSFKAGKKVATPGKRYIYKGGKRVLAQDDILVPRGALSEESVYGSISTIERNVPAKNLFEHPERIFKGYIRKLVEERIAEYGGDWKKARASLNKRPIFLDDKGQRKLEYATCWKEEMVLRYPIEKIDKGKVDKIVDSHILDIIRKRIEEAGEKNAFKEPIYADEACTIPIRHVRLFTGLTAVEPIKYADGQPVGFVKPGNNHHIAFYVDAQGNKSEHVVTFWHALERKKYGFPIIIEDTDAVWEKVDQMDLPEAFVRNLPEPGLKLDMSLQQNEMFILGMGEDTYRDAMAAKDYKTLCKHLYRVQNIANLDYYFRLHIDTSDDKSNEAQKIKKFYRVRSISSLMDLNPKKVKISILGEIFPLDD

SEQ ID NO: 1295 - protein, 1224 aa, unidentified
  REGION 1..1224: note = Description of Unknown: uncultivated organism with predicted taxonomy: Sediminibacterium sp. C3
  REGION 1..1224: note = MG16-214 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQTPMELWQKRADAASKEISLVELGRVLLHINQKRGYKHSRLSNSDSKETAYVQEVNSRYDDLKAEGLTVGQHFAAKLKENEQLSAAGKKYYNYRIKEQVYPRCAYEEEVKKILEVQSQYHSDVLTADACKEMMDIIFYQRDLKSCKNLVSLCEFESYTITKNGKEITIGPKVAPRTSPLAQLSSILETANNITIRNKRNDELYISPEQRKAIADFLDTHEVLKLSDLYKILNIGRKDGWWAGKAIGKGLKGNTTKCQIRKALSKLPKDLVDSLTAFQLEFEECVDQETGEVRKRINNTLVEKQPLYHLWHLIYSIKDVDELSGALRHLGIEDEESIRNLCDLDFRTAGYANKSAKAIGRILPYLMEGVMYSEACERAGFDHSRRIDPNRTLLKHLPPIQKNELRQPVVEKILNQLVNIINALIEKEGAIDEIRVELARELKQSKDERNETFKRNNQNERQNKEYAERIKEYGLTPTRNRIMKMKMWEESEYTCMYCGQPVNVTEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWIVVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKNENGVISETIVTKWQAVQRKVNHIPIIIDNPSQTWSKVLGRNNVPEELLQSLPRDSSSFLLSLQIGEAFIMGMEEAEFQKALEEKDMQTLAEHLYFVQNISSNNYRMRRHVESSFDTTDMNKEDQRFFNIQSISSFFNSNPHKVKITILGDIVVDV

SEQ ID NO: 1296 - protein, 1222 aa, unidentified
  REGION 1..1222: note = Description of Unknown: uncultivated organism with predicted taxonomy: Prevotella
  REGION 1..1222: note = MG16-215 effector
MKKVLGLDLGVGSIGWCLIEKDDNNTPKRIIRMGSRIVPISSDEETGYTKGNAISKNADRTAKRTARKCYDRYQLRRQALVNLLKQLGMGPSKNLMLEQTPIELWQKRADAASKEITLEELGRVLLHINQKRGYKHSRLSNSDSKETAYVQEVNSRYDDLKAEGLTIGQHFAAKLKENEQESADGKRYYNYRIKEQVYPRHAYEEEAKRILEVQSRYHSDVLTSDVCKEMMDIIFYQRDLKSCKNLVSLCEFESYTITKDGKEITIGPKVAPRTSPLAQLSSILETANNITIRNRKNDELYISPEQRKAIADFLDNHEVMKLTDLYKILKIGRKDGWWAGKAIGKGLKGNTTKCQIREALSALPKEQVDSLTAFQLEIDEYVDEETGEVRKRINNTKAEKQPLYRLWHLLYSIKDVDELSGALHNLGIEDEESIEKLCNLDFRTAGYANKSAKAIGRILPYLMEGVMYSDACERAGFDHSRRINPDRVLLTHLPQIQKNELRQPVVEKILNQLVNIVNALLEKEGTIDEIRVELARELKQSRDERNETFKRNNQNERQNKVYAERIKEYGLTPTRNRIMKMKMWEESEYTCMYCGQPVNVTEFLKGADVEREHIIPRGLLFDNSFTNQVCSCRRCNSKKGMRTAYDFIADDKGQDGLNAYIDRINNLFDKKKISRSKLNRLLVSHKAYISRKAQGKETDEDKELWENFIDRQLRQSQYIAKKSVEMLQQVCKNVYTTSGSVTDFVRHQWGYDDLLHDLNFERFKKAGLTAMVKQLHSGKEVEMERIKDWTKRLDNRHHAVDALAIACTTQGMIQRLNTLNASRDEILEELNSKDQRVVDPERSMLEKWVYAQPHISYAEAKNEIDKIVISQRPNTRITVPGKRYVTKNGKRTLAQTGIIVPRGALHAEFVYGRIMKQEADGVTMTPQYVRKYKLGIGTQGFLFKGDEVYKEELKKDSKTGLSKIVVTDKIMDVLEKIVDGGIRQRILERLNRGFEEGTDYRANVAQALANLKNLDEDPIYSDDAKTRPIRTVRKYVSSSTMVAVRKDSNGKPISFVEPDDNHHVAFYMYQDGERTESVVTKWQAVQRKLNHIPIIIDNPSQTWNEVLGRNDVPDELLQSLPQDKSIFLLSLQKGEAVVMGLEEMNYQRALEKKDMRTLCNHLFYVQSASSHDYRFRRHVEAKYDTKDMNKDDMRFLRIRTVDELFKNNPHKVKVTVLGDIVE

SEQ ID NO: 1297 - protein, 1222 aa, unidentified
  REGION 1..1222: note = Description of Unknown: uncultivated organism with predicted taxonomy: Bacteroidales
  REGION 1..1222: note = MG16-216 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1298 - protein, 917 aa, unidentified
  REGION 1..917: note = Description of Unknown: uncultivated organism with predicted taxonomy: Porphyromonas catoniae
  REGION 1..917: note = MG16-217 effector
MKKVLGLDLGVGSIGWCLIEKDDNNTPKRILRMGSRIVPISSDEETGYTKGNAISKNADRTTKRTARKCYDRYQLRRQALVNLLKKLGMEPSKNLMLEQTPMELWQKRADAASKEVSLDELGRVLLHINQKRGYKHSRLSNSDSKETAYVQEVNSRYKDLKAEGLTIGQHFAAKLKENEQETADGKKYYNYRIKEQVYPRHAYEEEVKKILEVQSQYHSDLLTSDVCKEIADIIFYQRDLKSCKNLVSFCEFESYAITKDGKEITIGPKVAPRTSPLAQLSSILETANNITIRNRKNDELYISPEQRKAIADFLDNHEVMKLTDLYKILNIGKKDGWWAGKAIGKGLKGNTTKCQIREALANLPKEQVDSLTVFQLDIDNYVDEETGEVRQRINNTKAEKQPLYRLWHLLYSIKDVDELSGALRHLGIEDEESIEKLSKLDFRTAGYANKSAKAIGRILPYLMEGMMYSDACERAGFDHSRRINPDRALLTYLPQIQKNELRQPVVEKILNQLVNIVNALLDKEGAIDEIRIELARELKQSKDERNEAFKRNNQNERQNKEYAERIKVYGLTPTRNRIMKMKMWEESEYTCMYCGQPVNVTEFLQGADVEREHIIPRGLLFDNSFTNQVCSCRRCNSKKGMRTAYDFIADDKGQEGLDAYIDRINDLFNKKKISRSKLNRLLVSHKAYIIRKTQGKETEEDKELWENFIDRQLRQSQYIAKKSVEMLQQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQ

SEQ ID NO: 1299 - protein, 1224 aa, unidentified
  REGION 1..1224: note = Description of Unknown: uncultivated organism with predicted taxonomy: Prevotella
  REGION 1..1224: note = MG16-218 effector
MKKVLGLDLGVGSIGWCLIEKDDNNTPRRILRMGSRIVPISSDEESGYTRGNAISKNADRTAKRTARKCYDRYQLRRQALVNLLKKLGMEPNKNLMFEQTPLELWQKRADAASKEITLEELGRVLLHINQKRGYKHSRLSNSDSKETAYVQEVNSRYVVLRAEGLTVGQHFAAKLKENEQESADGKKYYNYRIKEQVYPRHAYEEEVKKILEVQSQYHSDVLTSDVCKEIGDIIFYQRDLKSCKNLVSFCEFESYTIKKDGKKITIGPKVAPRTSPLAQLSSILETANNITIRNRRNDELYISPEQRKAIAEFLDNHEVMKLTDLYKILNIGKKDGWWAGKAIGKGLKGNTTKCQIREALSGLPKEQVDSLTAFKLEIDECVDEETGEVRKRIDNTKAEKQPLYRLWHLLYSIKDNDELTGALRHLGIENKEIIEKLCKIDSRTAGYANKSAKAIGRILPYLMDGVMYSEACGRAGYDHSRRVNPDRVLLTHLPQIQKNELRQPVVEKILNQLVNIVNALLEKEGAIDEIRVELARELKQSKDERNEVFKRNSQNERKNKEYAERIKEYGLTPTRNRIMKMRMWEESEYTCMYCGQPVNVSEFLKGADVEREHIIPRGLLFDNSFTNQVCSCRRCNSKKGMRTAYDFIADEKGQEGLDIYIDRINDLFNRKKISRSKFNRLMASHKAYMRRKAQGKETDEDKELWENFIDRQLRQSQYIAKKSVEMLQQVCKNVYTTSGSITDFVRHQWGYDELLHELNFERFKKAGLTAMVKQLQSGKEVEVERIKDWTKRLDNRHHAVDALAIACTTQGMIQRLNTLNASRADMLEELSSNDRRLVDPDRSMLEKWIYVQPHISYAEAKNEIDKIVISQRPNTRITVPGKRYVIKSGKRTLAQTGIIVPRGALHAEFVYGRIQKQEADGDTKTYQYVRKYKLGIGAQGFLFNGKEFYKEELKKDSKTGLSSIVVTDKIKDVLDKIVDGGIRQRILERLNRGFEEGADYRANVARALENLKNLDEDPIYSDDAKTRPIRTVRKYVSSSTMVAVRKDSNGKAISFVEPDGNHHVAFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 1300 - protein, 1228 aa, unidentified
  REGION 1..1228: note = Description of Unknown: uncultivated organism with predicted taxonomy: Fibrobacter
  REGION 1..1228: note = MG16-219 effector
MKKILGLDLGVGSIGWSVISVDENGDPSEILGMGSRIIPLSTDDANEFSTGNAISKNQKRTQKRTARKGYDRFQLRRENLTAELRKLHMLPDEKLIKLPILELWTLRAKAATEGNKLSLPEIGRILYHINQKRGYKHAKADEAGDKQQTEYVAAVNSRYAMIKERCQTIGQYFAEKIRESEVISEKGKFYTFRTKEQVFPRKAYEEEFDKIIAVQRQYYPDVLTDSAINRLRNEIIFYQRNLKSCKHLVSLCEFEKHEYKNKEGQIVYDGPKVAPRTSPLAQICRIWEFVNNISLENGYKERRELSLEEKQKVIHFLDNNEKMTATDFSKLLGLGKKNEWDLKRYFGKNGVKGNETKVSLRNALKDFPNVEELLQFNLTLDNSNYVNESTGEVLKVISPSFQNEPLYDLWHTVYSLSDKDELSNALGKKFGISDKNAIQQLFKIDFVKPGFSNKSAKAVRRILPFLQQGLMYSEACAEAGYNHSNSLTKTENEARSLLDRLPQIKKNELRQPVVEKILNQMVNVVNAIYDDYGTIDEIRVELARELKQSKDERNTTFNNIAKRERENKGIAERIKNEYGLIPNRNKIEKYRLWEEAEQKCFYCGQTVNVKEFLSGFDVEVEHVIPKSLLFDNSYANKVCACRKCNANKGNKTAFDFMKSQSEDAFNNYVSRVEEYYKNGKISRTKHDRLLTPQSEIPSDFIERQLRQTQYISKKALEMLKEVCCKVYATNGSVTDFIRHTWGYDEILHQLNFDRYKQGGLTEVREFDNKGIIHKEERIQNWSKRLDHRHHAIDALVIAMTKQSIIQRLNHLNTERDAMFQEVDKQSAEWKNDFSLLQEWLRERKHFSTKDVADRVAEILISFKAGKRVATTGKRIKYEKGQKKVLQEGIVIPRGALSEESVYGKIKVIDPHKPLKFLFENPQTIVSPQIKTAVIDRLSKFGNDVKKAIASIKKEPLTLASDKVINDADCFKEEYVIKYPLEGFKAKDIQFVVDKHIREDVLPKRLAEFDGNEKNAFKNIDKNPIFADANHNIPIKHVRCFTGLSAVVPVKHDDAGKAIGFVKPGNNHHVAIYKDECGKLHESLVSFWNAVERKIKKVPVVITQPQDAWNIAENAHCSEEFTASLPNKTWTFVQSLQVNEMFVLGLEESAYQKAVREKDYNLINKHLYRVQSISKSDYFFRHHLETIIDDTSASKEMKRFYRFKSLGSFFKENPHKVQISVLGKLIVKE

SEQ ID NO: 1301 - protein, 1222 aa, unidentified
  REGION 1..1222: note = Description of Unknown: uncultivated organism with predicted taxonomy: Sediminibacterium sp. C3
  REGION 1..1222: note = MG16-220 effector
MKKVLGLDLGVGSIGWCLIEKDDDNTPKRIIRMGSRIVPISSDEETGYTKGNAISKNADRTAKRTARKCYDRYQLRRQALVNLIKRLYMLPNKELMLEQTPLEIWQKRADAASKEITLEALGRVLLHINQKRGYKHSRLSNADRKETAYVQEVNSRYDELKAEGLTIGQHFAAKLKENEQTSNDGKKYYNYRIKEQVYPRHAYEEEVKKILEIQSQFHADVLTPDVCREIMDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLNACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1302 - protein, 1018 aa, unidentified
  REGION 1..1018: note = Description of Unknown: uncultivated organism with predicted taxonomy: Sediminibacterium sp. C3
  REGION 1..1018: note = MG16-221 effector
MKKVLGLDLGVGSIGWCLIEKDDNNTPKRILRMGSRIVPISSDEESGYTKGNAVSKNADRTAKRTARKCYDRYQLRRQALINLLKRFGMEPNKNLMLEQTPIKLWQKRADAASKEVSLEELGRVLFHINQKRGYKHSRLSNSDSKETAYVQEVNSRYDDLKAEGLTVGQHFAAKLKENEQESADGKKYYNYRIKEQVYPRHAYEEEVKKILEVQSRYHSDILTPDVCKEIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKYQIREALANLPKEKVDSLTAFQLEFDEYVDEETGEVRKRINNTKAEKQPLYKLWHLLYSIKDNKELSGALCHLGIEDEESIEKLGKLDFRTAGYANKSAKAIGRILPYMMEGMMYSDACERAGFDHSKRIDPNRTLLTHLPQIQKNELRQPVVEKILNQLVNIVNALLEKEGTIDEIRVELARELKQSKDERNETFKRNSQNERNNKEYAERIKEYGLTPTRNRIMKMKMWEESEYTCVYCGQPVNVTEFLKGADVEREHIIPRGLLFDNSFTNQVCSCRLCNSKKGMRTAYDFIADDKGQAGLETYIDRINDLFNRKKISRSKFNRLLVSYKAYISRKAKGKETEEDKELWENFIDRQLRQSQYIAKKSVEMLQQVCKNVYTTSGSVTDFVRHQWGYDEILHDLNFERFKKAGLTAMVKQLHSGKEVEVERIMDWTKRLDNRHHAVDALTIACTTQGMIQRLNTLNASRDEMLEELNSKDQRVVDPERSMLEKWIFVQPHISYVEAKNEIDKIVISQRPNTRITVPGKRYVNKNGKRTLVQTDIIVPRGALHAEFVYGRILKQEADGVTMTPQYVRKYKLGIGAQGFLFNGKEFYKEELKKDSKTGLSSIVVTDKIKDVLEKIVDGGIRQRILERLNRGFEEGTDYRANVAKALANLKNLDEDP

SEQ ID NO: 1303 - protein, 1222 aa, unidentified
  REGION 1..1222: note = Description of Unknown: uncultivated organism with predicted taxonomy: Prevotella sp. ne3005
  REGION 1..1222: note = MG16-222 effector
MKKVLGLDLGVGSIGWCLLEKDDKNVPIRIIRMGSRIVPISTDEETGFTKGNAISKNADRTAKRTARKCYDRYQLRRQALVNLLRRLGMEPSKNLMLEQPPMELWQKRADAASKEISLVELGRVLLHINQKRGYKHSRLSNSDSKETAYVQEVNSRYDDLKAEGLTVGQHFAAKLKENEQLSADGKKYYNYRIKEQVYPRCAYEEEVKKILEVQSQYHSDVLTADACKEIMDIIFYQRDLKSCKNLVSLCEFESYTITKNGKEITIGPKVAPRTSPLAQLSSILETANNITIRNKRNDELYISPEQRKAIADFLDTHEVLKLTDLYKILNIGRKDGWWAGKAIGKGLKGNTTKCQIRKALSKLPKDLVDSITAFQLEFEEYVDQETGEVRKRINNTLVEKQPLYHLWHLIYSIKDVDELSGALRHLGIEDEESIRNLCDLDFRTAGYANKSAKAIGRILPYLMEGVMYSEACERAGLDHSRRIDPNRTLLKHLPPIQKNELRQPVVEKILNQLVNIVNALLEKEGAIDEVRVELARELKQSKDERNETFKRNNQNERQNKEYAERIKKYSLTPTRNRIMKLKMWEESEHACMYCEEPVDPIEFLKGADVEREHIIPRGLLFDNSFTNQVCSCRRCNSKKGMRTAYDFIADDKGQEGLNAYIDRINDLFDKKKISRSKLNRLLVSHKAYISRKAQGKETEEDKELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALTIACTTQGMIQRLNTLNASREDILEELNSKDQRLVDPERSMLEKWVFVQPHISYSEAKNEIDKIVISQRPNTRMTVPGKRYVTKNGKRTLAQTGIVVPRGALHAEFVYGRIMKQEPDGITMTPQYVRKYKLGIGAQGFLFNGKEFYKEELKKDSKTGLSKIVVTDKIKEVLDKIVDGGIRQRILERLNRGFEEGADYRANVAQALTNLKNLDEDPIYSDDAKTRPIRTVRKYVSSSTMVAVRKDDKGKPVAFVEPDGNHHVAFYKDENGVISETIVTKWQAVQRKLNHIPIIIDNPSQTWSEVLGRNNVPEELLQSLPKDSSSFLLSLQIGEAFIMGMEEAELQKALEEKDMQKLAEHLYFVQNISSNNYRMRRHVESSFDTTDMNKEDQRFLNISSLDALYRLNPHKVKLTVLGDIVP

SEQ ID NO: 1304 - protein, 1222 aa, unidentified
  REGION 1..1222: note = Description of Unknown: uncultivated organism with predicted taxonomy: Prevotella copri
  REGION 1..1222: note = MG16-223 effector
MKKVLGLDLGVGSIGWCLVEKDDKNIPLRIIRMGSRIVPITKEEENGYTRGNAISKNADRTTKRTARKCYDRYQLRRKALVNLLKRCGMMPDKGLILEQSPLDLWQKRADAASKEISLEELGRVLLHINQKRGYKHSRLSNSDKKETAYVQEVNSRYDKLKAEGLTVGQHFAAKLKENEQISADGKKYYNYRIKEQVYPRHAYEEEAKRILEVQSQFHTDVLTTNVCKEIFDIIFYQRDLKSCKNLVSFCEFESYTINKNGKDITIGPKVAPRTSPLAQLSSILETANNITIRNRRNDELYISPEQRQAIANFLDNNEVMKLTDLYKILNIGRKDGWWAGKAIGKGLKGNTTKCQIRKALSKLSQEQIDKLTSFDLIFDEYVDEETGEVRKRINNSHAERQPLYRLWHLVYSIKDNDELSGALRGLGIEDEECIHNLCNLDFRTAGYANKSAKAIGRILPYLMEGMMYSEACNRAGFDHSRRVNPERELLTSLPQIQKNELRQPIVEKILNQLVNVVNALLEKEGTIDEIRVELARELKQSKDERNETYRRNNQNEKKNNEYAERIKEYGLTPTRNRIMKMKMLEESEYKCMYCGQPVREKEFLQGADVEREHIIPKALLFDNSFTNQVCSCRSCNSQKGMRTAYDFIADDKGQEGLEAYIERINDLFNKKKISRSKLNRLLVSHKAYVSRKAQGKETEEDVQLWENFIDRQLRQSQYIAKKSVEILQQVCKNVYTTSGSVTDFVRHQWGYDEILHDLNFEHFKKANLTTMVKQLHSGKEVEVERIKDWTKRLDNRHHAVDALAIACTTQGMIQRLNTLNASRDAMLDELNNKEQRMIDSERSMLEKWIISQPHVSYAEAKKEIDKILISLRPNTRITVPGKRYITKNGKRTLVQTGIIVPRGALHAEFVYGRIMKQEADGVTLTPQYVRKYKLGIGTQGYIFNGNETYKEELKKDKKTGLSQIVVTDKIKDVLEKIVDGGIRKRILERLNRGFEDGTDYRTNTAKALENLKNLDEDPIYSDDAKTRPIRTVRKYVNSSTMVAVRKNDNGKPVSFVEPDDNHHVAFYKDKDGVITESIVTKWQAVQRKLKHIPVIVDNPTQTWNDLVGRNDVSEELLQSLPKDNSEFLLSLQKGEAVILGLEEAAYQKAIDSNDMHTLSNHLYFVQSASLSDYRFRRHVESSFDKMGMNKEDQRFLNVKSIGAFFNYNPHKVKVTILGDIIK

SEQ ID NO: 1305 - protein, 848 aa, unidentified
  REGION 1..848: note = Description of Unknown: uncultivated organism with predicted taxonomy: Bacteroides sp. CAG:770
  REGION 1..848: note = MG16-224 effector
MKKVLGLDLGVGSIGWCLIEKDDNNVPKRILRIGSRIVPISSDEETGYTKGNAVSKNADRTAKRTARKCYDRYQLRRQALVSLLKRLGMEPNKKLMFEQTPMELWQKRADAASKEVSLEELGRVLLHINQKRGYKHSRLSNSDSKETAYVQEVNSRYDDLKAEGLTVGQHFAAKLKENEQESADGKKYYNYRIKEQVYPRHAYEEEVKKILEIQSQYHSEVLSSDVCKDIMDIIFYQRDLKSCKNLVSLCEFESYTITKDGKEITIGPKVAPRTSPLAQLSSILETANNITIRNRKNDELYISPEQRKAIADFLDNHEVMKLTDLYKILNIGRKDGWWAGKAIGKGLKGNTTKCQIREALSALSKEQIDSLTAFLLEIDEYVDEETGEVRKRINNTLAEQQPLYKLWHMLYSIKDNKELSGALNHLGIEDKESIEKLCKLDFRTAGYANKSAKAIGRILPYLMEGMMYSDACERAGFDHSRRINPERVLLTHLPQIQKNELRQPVVEKILNQLVNIVNALLEKEGAIDEIRVELARELKQSKDERNEAFKRNNQNERQNKELAERIKNYGLTPTRNRIMKLKMWEESEHSCMYCKQPVDPIEFLKGADVEREHIIPRGLLFDNSFTNQVCSCRRCNSQKGMRTAYDFIADDKGQEGLNAYIEHINDLFEKKKISRSKLNRLLVSHKAYLSRKAQGRETEEDKELWENFIDRQLRQSQYIAKKSVEMLQQVCKNVYTTSGSVTDFVRHQWGYDELLHELNIERFKKAGLTAMVKQLHSGKEVEVERIKDWTKRLDNRHHAVDAFAIACTTQGMIQRLNTLNASRDEMFEELNTKDQRLIDPERSMLEKW

SEQ ID NO: 1306 - protein, 1164 aa, unidentified
  REGION 1..1164: note = Description of Unknown: uncultivated organism with predicted taxonomy: Bacteroidales
  REGION 1..1164: note = MG16-225 effector
MATKKILGLDLGVGSIGWALIEMEDDKASSILGMGSRIVPLTTDDSTQFSKGQAITKNADRTARRTARKGYDRYQLRRAKLTQVLRQHNMLPERMDEHVIDLWRLRADAATEGKQLTLQQIGRVLYHINQKRGYKHAKADVSADSKQTKYVATVNQRYKDLQNLNQTIGQFFYQQLVDTAVQTPSGPYYTFRIKDKVFPRAAYVAEFDQIMQVQKIFYPEVLTTELINTLRNEIIFYQRPLKSCKHLVGLCEFEMKAYTNKHTGQVVYSGPKCAPRTSPLAQLCAIWEGVNNITLFNKHNEYLDITLEQRKAMVEHLCNNEKMTAKDLQKILGISSKEGWSVEKAIGKGLKGNMTLHQLRKALSKKYSDLLQFDLLMTDHVDEATGEVISRISEAIEQEPLYRLWHVVYSVQEREELGKALHKQFGIDDEAVVEALFKIDFVKPGYANKSHKFIRKLLPYLMKGYKYSEACDHIYVNHSNSMTKEQNATRELVDKIPLLLKNELRQPIIEKILNQMINIVNTLKEQHGNIDEVRVELARELKQSKDERAQTTERINKNERENKAIEERIREHGIRPSRARIQKYKMWEESQHQCFYCGKSISAAEFLSGADVEVEHIIPKSILFDDSFSNKVCACRDCNHTKDNLTARDFMETRGQAELDAYLARVNTAFEEGRISKTKRDHLLWHKEEIPQDFIDRQLRQSQYISKKAVEILRSAIRDVYATSGSVTDFLRHIWGYDQILHNLNLPKYRDAELTEFVTYDHRGQEHQEERIKNWSKRIDHRHHAIDALTIALTRQGYIQRLNNLNASHDDIAEAVRKVNPLMEKKYSLLEKYIYIQPHFTVQEVTDKVDGILVSFRAGKKVTTPAKRAIYRKGKRINVQDGLLVPRGALTEETVYGKLGNKYVVKYPLTHPSMKVDDIVDPTIREIVRARLAAFSGKAKDAFAKPLYSDAAQKMEIKTVRCYTGLQDKAVASVRFNAQGEPIGFAKTGNNHHIAIYQDAKGQYQESVVSFWQAVERKRYGLPIVIEDPKAIWDKLLDSDLPQEFLSTLPQDDWQFVVSLQANEMFILGMEDGDFEMAMQNKDYQLLNKYLYRVQKIRGKEYTFRYHIETTVDDKYSNEKGESKPNPALSMQMKKLISIRSFGGWLAQHPHKVRVNLLGEISEV

SEQ ID NO: 1307 - protein, 811 aa, unidentified
  REGION 1..811: note = Description of Unknown: uncultivated organism
  REGION 1..811: note = MG16-226 effector
MVPLCYRSATVNGLKKPACILYAPFGDVQDANEMRMVEDAKWNENYWYLKSRHLMWRKHFFIYFYYLTQNFACIYQKKVLPLQRKGFGINTNTYIMTKNILGLDLGVGSIGWALIQTEDDQPKRIIGMGSRIVPLTKDDSDQFTKGQAISKNADRTTRRTTRKGYDRYQLRRALLTQVLRQNGMLPECMDENMIDLWKLRSDAATDGKQLTLQQIGRVLYHINQKRGYKHAKSDNDGDSKQTKYVEEVNLRYKEIQEKNVTVGQHFYAELLNSKVESGNGPYYTFRIKDKVFPRAAYIAEFDQIMRVQKCYYPDVLTDELIETLRNRIIFYQRPLKSCKHLVGLCEFEMRPYKKDGKIVYGGPKCAPRTSPLAQLCAMWETVNNITLTNRNNERLEISNEQRQQLVQFLCTHETLKLTDLYKILGITKKDGWYGGKAIGKGIKGNVTLNQLRKALDGKYSQWLEMPIERIDVVDKNTAEAFWAVSPKVDETPLFQLWHAVYSLQNAEELTKTLQNKFGITDSQVIDALCKIDFVKPGYANKSHKFIRRLLPYLMEGMMYSEACACIQVNHSNSMTKAEREARPLAEKIELLQKNALRQPVIEKILNQMINLVNRLQQEYGSIDEARVELARELKQSRDERKDAFDRNNENEKRNKKISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQAFIDRQLRLSQYIATKAVEILQQGIRQ

SEQ ID NO: 1308 - protein, 854 aa, unidentified
  REGION 1..854: note = Description of Unknown: uncultivated organism with predicted taxonomy: Bacteroidales
  REGION 1..854: note = MG16-228 effector
MADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKEEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1309 - protein, 887 aa, unidentified
  REGION 1..887: note = Description of Unknown: uncultivated organism with predicted taxonomy: Bacteroidales
  REGION 1..887: note = MG16-229 effector
LAQLCTVWEAVNNITLTNRQNETFEITQEQRVAMADFLNQHDKMGVKDLQKILGISPKDGWWAGKAIGKGLKGNTTFTQLREALGNLPDAEHLLEMKLHLVDSAVDTTTGELIRQVSPQVEEEPLFRLWHLVYSLQNEDELRKALRKQFGIDDEEILAKLCKIDFVKPGYANKSHKFIRKLLPYLMEGYQYHEACAHIGVNHSDSLTAEQNAARPLLDKIPLLEKNELRQPVIEKILNQMINVVNALKAEYGDIDDVRIELARELKSSKDEREAAFKRNNENERQNKIYEDRIREYGIRPSRSRIQKYKMWEESNHLCFYCGKPVNVTDFLAGAEVEIEHIIPQSVLFDDSYSNKVCACRTCNHTKGNQTAREFMETHSKAEYESYLLRVDDAFNAHRISKTKRDHLLWRKEDIPQDFIDRQLRQSQYIAKKAAEILRQGYRNVYATSGSVTDFLRHQWGYDEILHRLNLPRYQQVEGLTELVTYDHCGQEHQQERIKGWTKRLDHRHHAIDALTIALTQQSVIQRLNTLNTSREQMFDDLGKRTDTPEYTEKRSLLENWIDAQPHFSVQEVTDKVDGILVSFRAGKRAATPAKRAVYQNGKRHIVQTGLQVPRGALSEETVYGKLGNKYVVKYPLGHQSMKVDDIVDPTIREIVRTRLNAFGGKAKDAFAEPLYSDAAHQMQIKTVRCYMGLQDKAVVPVRFNAKGEPVGFVKMGNNHHIAIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 1310 - protein, 1175 aa, unidentified
  REGION 1..1175: note = Description of Unknown: uncultivated organism with predicted taxonomy: Bacteroides sp. CAG:545
  REGION 1..1175: note = MG16-230 effector
EFTSGNAASKNQKRTQKRTARKGYDRYQMRRQALTEKLRELKMLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEASDNVSRILVSFKAGKKVTTPGKRYVYRGGKRVLAQEGLLIPRGALCEESVYGRIHSLEKEVPVKKLFERVDDIVKPGIRTTVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGIPAPDWKFVMSMQQNEMFVLGMEDDEFRDAMEVKDYKTLGAHLYRVQKLTSIYYVFRHQYETQLDDSKGAQIMKKFYRAQSFKALFSLHPRKVSVSLLGEMALKDD

SEQ ID NO: 1311 - protein, 890 aa, unidentified
  REGION 1..890: note = Description of Unknown: uncultivated organism with predicted taxonomy: Bacteroides sp. CAG:770
  REGION 1..890: note = MG16-231 effector
MKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPSLMDGAKYSEACDVIGINHSDSITKAENQTRKLLTKLPQLQKNELRQPVVEKILNQMINVVNAVIDKYGSIDEIRVEMARELKLSKAGRESAAKNIRTREKANEEIAKRIEELGLVPSKNKILKYRLWEESGKRCFYCGQPVSAAEFLNGLDVEIEHVVPKSLLFDDSFSNKVCACRKCNAEKGNATAFDFMKGRGENAFEDYLKRVETAFKENKISQTKRNRLLTPADKIPKDFIARQLVQTQYISRKAMEILNQVCRNVYGSSGDVTAYLRRIWGYDEILHSLDLPRYREGNLTGDVTYVHRGQTHTEERIRDWSKRLDHRHHAIDALTIACTRQSIIQRLNILNAKTAIGEEQMSLDKWTLAQAHFSVADVADHVADILVSFKSGKRVTTPGKRYVYKAGRRIVAQENILVPRGALSEESVYGRIKSIEEKVPVKKLFERADDIVKPRIRHLIRERLATCGGDCSKAVSSLKKSPLYLDEENTIMLEYGSCFKPEYVIKYSLNSIKAKDAVSIVDNHVREVVTERLAAFGDDPKKAFAEPLYADETGKIQIKTVRCYTGLSQVVPVKKDADGNDIGFVKPGNNHHIAIYKDADGKYQESIVTFRDAVERKKYGIPVVVRNPVEVLDTIIDKNVPEDLAGGLPSPEWTFVMSMQQNEMFVLGMGDDEFNDAMAGMDYKSLGEHLYRVQKLASLYYVFRSQYETKLDDSNNALAMRKFYRIRSFNALFSLNPRKVSISLLGEISLKDD

SEQ ID NO: 1312 - protein, 1133 aa, unidentified
  REGION 1..1133: note = Description of Unknown: uncultivated organism with predicted taxonomy: Bacteroides sp. CAG:770
  REGION 1..1133: note = MG16-232 effector
MLPDERLIKLPVLELWTLRAKAATPGEKLTLPEIGRVLYHINQKRGYRHAKSDDSADKEQRDYVQTVNKRYQEIKDEGTTIGQHFAIKLKESEIVTEKGPFYNYRIKEQVFPRDAYIEEFDRIMDCQKTFYPEELSEDNIDEIRNKIIFYQRNLKSCKHLVSQCEFMTRSFLDAEHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFVLRLKENGVNKDTGEIIYEIDPTCENEPLYRLWHVIYSINDKDALRHALTNQFGINDGESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLSQPHFSVQEVSDNVSRILVSFKAGKKVTTPGKRYVYRGGKRVLAQEGLLIPRGALCEESVYGRIHSLEKEVPVKKLFERIDDIVKPGIRAAVEERLRACDNDVKVACASLKKEPLYLDVEKTIPLEYGTCYKAKYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIDYYFRSQYETALDNSAGARMMKKFYRINSIKSLFALHPRKVSVSLLGEMALKDD

SEQ ID NO: 1313 - protein, 1010 aa, unidentified
  REGION 1..1010: note = Description of Unknown: uncultivated organism with predicted taxonomy: Bacteroides sp. CAG:545
  REGION 1..1010: note = MG16-233 effector
MDCQKTFYPEELSEDNIDEIRNKIIFYQRDLKSCKHLVSQCEFMTRSFLDADHKPILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHALDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDAEKTIPLEYGTCYKAEYVMRYALSALKPKDVEFIVDEHIRKVVSERLSEYGNDPKKAFAEPLYADKSKTIPIRAVRCYTGLAQVVPVKKDSKGNDIGFVKPGNNHHIAIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 1314 - protein, 1121 aa, unidentified
  REGION 1..1121: note = Description of Unknown: uncultivated organism with predicted taxonomy: Bacteroides sp. CAG:770
  REGION 1..1121: note = MG16-234 effector
MDLWTLRARAATPGEKLSLAEIGRVLYHLNQKRGYRHSKEDDSADKTQRDYVQAVNKRFQEIKNEGLTIGQHFAVKLKESEVITDKGAFYNYRIKEQVFPRAAYVEEFDRIIQCQREFYPEVLTEANVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIEEVLRFDLSAVESNQVNADTGEVLMEISAECGREPLYRLWHIIYSISDKNEQKSALKSQFGILDESMLESLCRIDFVKQGYSSRSFKFMRKILPSLMDGAKYSEACDAVGINHSDSITKAENQARELLVKLPQLQKNELRQPVVEKILNQMINVVNAVIDKYGAIDEIRVEMARELKLSKEGRESAAKNIRAREKANEEIAKRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENRISQTKKNRLLTPADKIPKDFISRQLVQTQYISRKAMEILNQVCRNVYGSSGDVTAYLRRIWGYDEILHSLDLPRYREGNLTGDVTYVHRGQTHTEERIKDWSKRLDHRHHAIDALTIACTRQSIIQRLNTLNAKTAIGEEQISLDKWTLAQAHFSVADVADHVADILVSFKSGKRVTTPGKRYVYKAGRRRVVQENILVPRGALSEESVYGRIKSIEEKVPVKKLFERVDDIVKPRIRRLIRERLEACGGDCSKAVSSLKKSPLYLDEEKTIMLEYGSCFKYSYVKKSKLIQRDKKDDFINVSLIVDKHIREVVTARLAAFGGDTKKAFAEPLYADEAGKIQIRTVRCYTNSTVVPVKKDADGNDIGFVKPGNNHHIAIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 1315 - protein, 1121 aa, unidentified; identical to SEQ ID NO: 1314
  REGION 1..1121: note = Description of Unknown: uncultivated organism with predicted taxonomy: Bacteroides sp. CAG:770
  REGION 1..1121: note = MG16-235 effector

SEQ ID NO: 1316 - protein, 1045 aa, unidentified
  REGION 1..1045: note = Description of Unknown: uncultivated organism with predicted taxonomy: Bacteroides sp. CAG:770
  REGION 1..1045: note = MG16-236 effector
KLKESEIITDKGAFYNYRIKEQVFPRAAYVEEFDRIIQCQREFYPEVFTEAIVNEIRNEIIYYQRPLKSCKHLVSVCEFMQRELFDAEHNPIRNGKGEIVVAGPKCAPKSSPLAQVCKIWEEVNNIRITNKENDEYFISIDNKHEIFDFLNTHEKMKADDLFKILGLAKNSGWSADRAMSKGMVGNTTRVALMKALKGRRDIDEILRFDLREVESNQVNADTGEVLMEIGAECESEPLYRLWHIIYSISDKNEQKATLEKQFGITDESMLESLCRIDFVKQGYSSRSFKFMRKILPYLMDGAKYSEACDAVGINHSDSITKAKNQARELLVKLPQLQKNELRQPVVEKILNQMINVVNAVIDKYGAIDEIRVEMARELKLSKEGRESAAKNISDRKKANEEIARRIEELGLVPSKNKILKYRLWEESGKRCFYCGQPVSAAEFLNGLDVEIEHVIPKSLLFDDSFSNKVCACRKCNAEKDNATAFDFMKGRGENAFEDYLKRVETAFKENKISQTKRNRLLTPADKIPKDFISRQLVQTQYISRKAMEILNQVCRNVYGSSGDVTASLRRIWGYDEILHSLDLPRYREGNLTGDVTYVHKGQTHTEERIKDWSKRLDHRHHAIDALTIASTRQSIIQRLNTLNAKTAIGEEQISLDKWTLAQAHFSVADVADHVADILVSFKSGKKVATPGKRYVYKAGRRRVVQENILVPRGALSEESVYGRIKSIEEKIPVKKLFERADDIVKPRIRRLIRERLEACGGDCSKAVSSLKKSPLYLDEEKTIMLEYGSCFKPEYVIKYSLNSIKAKDAVSIVDKHVREVVTERLAAFGDDPKKAFAEPLYADEAGKIQIKTVRCYTGLSQVVPVKKDADGNDIGFVKPGNNHHIAIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 1317 - protein, 956 aa, unidentified
  REGION 1..956: note = Description of Unknown: uncultivated organism with predicted taxonomy: Bacteroides sp. CAG:770
  REGION 1..956: note = MG16-237 effector
PILNSSGELVMSGPKVAPKSSPIFQACKIWEEINNLSIRNKENDELHISPEQKKDIFEYLDNNEKINATALYKILGIGKGDGWSVDKALSKGFTGNTTKVAIAKALGKDHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRAAVEERLRACDNDVKVACASLKKEPLYLDVEKTIPLEYGTCYKVEYVMRYALSALKPKDVEYIVDEHIRKVVSERLSEYGNDPKKAFAEPLYADKSKTIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEVKDYKTLGEHLYRVQKLTSLYYVFRHQYETQLDDSKGAQIMKKFYRVRSFNAMFALHPRKVSVSLLGEMALKDD

SEQ ID NO: 1318 - protein, 970 aa, unidentified
  REGION 1..970: note = Description of Unknown: uncultivated organism with predicted taxonomy: Bacteroides sp. CAG:545
  REGION 1..970: note = MG16-238 effector
MRIYDKEFPGRRSQTNIEQFRRTRNAGPKVAPKSSPIFQACKIWEEINNLSIRNKENDELHISPEQKKDIFEYLDNNEKINATALYKILGIGKGDGWSVDKALSKGFTGNTTKVAIAKALGKEHNTKKSDLLRFDLRLKENGVNKDTGEIIYEIDPTCENEPLYRLWHVIYSINDKDALRHALTNQFGINDEESLRELTKIDFVKQGYGSRSAKFMRKLLPALMDGARYSEACDMIGINHSGSLTKSENEARELLHKIPQLQKNELRQPVVEKILNQMINVVNAVIDQFGSIDEIRVEMARELKLSKEGRAATAKNIRDREKMNNEMAEKIKELGITPSKNKILKYRLWQESGQKCFYCGQPVGAAEFLSGLDVEIEHIVPKALLFDDSFSNKVCACRKCNAEKSNTTAYDYMKSKGENEFNDYLRRVDAAFNEHKISFTKRSRLLTPADKLPKDFISRQLVQTQYISRKAMEILKQVCHNVYGSSGEVTSYLRRIWGYDEILHSLDLPRYREGGMTAEVSYDHRGQTHTEERIKDWSKRLDHRHHAIDALTIACTRQSIIQRLNNLSAMTAVAGESMSLDKWTLAQPHFSVQEVSDNVSRILVSFKAGKKVTTPGKRYVYRGGKRVLAQEGLLIPRGALCEESVYGRIHSLEKEVPVKKLFERVDDIVKPGIRTAVEERLRACDNDVKVACASLKKEPLYLDVEKTIPLEYGTCYKAKYVMRYALSALKPKDVEFIVDEHIRKVVSERLSEYGNDPKKAFAEPLYADKSKMIPIRAVRCYTGLAQVVPVKKDSKGNDIGFVKPGNNHHIAIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMKKFYRITSIKSLFALHPRKVSVSLLGEMALKDD

SEQ ID NO: 1319 - protein, 788 aa, unidentified
  REGION 1..788: note = Description of Unknown: uncultivated organism with predicted taxonomy: Bacteroides sp. CAG:770
  REGION 1..788: note = MG16-239 effector
LTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVLVKKLFERVEDIVKPGIRAVVEDRLKACDNDVKAACTSLKEEPLYLDAEKTIPLEYGTCYKREYVIKYPISSLKTKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 1320 - protein, 1182 aa, unidentified
  REGION 1..1182: note = Description of Unknown: uncultivated organism with predicted taxonomy: Bacteroides sp. CAG:709
  REGION 1..1182: note = MG16-240 effector
LSPDESSEFTSGNAASKNQKRTQKRTARKGYDRYQMRRQALTDKLRKLKMLPDEHLIKLPILDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDKVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYTYRGGKRILAQDGLLIPRGALSEESVYGRISALEKNVPVKKLFERVEDIVKPGIRAVVEDKLKACDNDVNAACASLKKEPLYLDAEKTIPLEYGTCYKRKYVIKYPISSLKAKDVESIIDGHIRQIVSERLSEYGNDPKKAFAEPLYADDAKTIPVRTVRCYTGLDQVVPVKKDVAGNDIGFVKPGNNHHIAIYRDADGKFHECVVTFWDAVERKKWGIPVIVRNPDEVWDVVIDKNVPEELAAGLPALGWSFVMSLQQNEMFVLGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1321 - protein, 1180 aa, unidentified
  REGION 1..1180: note = Description of Unknown: uncultivated organism with predicted taxonomy: Bacteroides sp. CAG:770
  REGION 1..1180: note = MG16-242 effector
PDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEGHRPVLDASGKLVISGPKVAPKSSPIFQVCKIWEEINNLSIRNKENDELHISPEQKKEIFEYLDNNEKITSAALYKILGIGKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKIINQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKALLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGKRYVYRGGKRILAQEGLLIPRGALCEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAKTIPVRTVRCYTGLDQVVPVKKDVAGNDIGFVKPGNNHHIAIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1322 - protein, 1221 aa, unidentified
  REGION 1..1221: note = Description of Unknown: uncultivated organism with predicted taxonomy: Bacteroides sp. CAG:709
  REGION 1..1221: note = MG16-243 effector
MKKNLGLDLGVGSIGWSLINADKDNKPIAILGLGSRIISLSPDESSEFTSGNAASKNQKRTQKRTARKGYDRYQMRRQALTDKLRKLKMLPDEHLIKLPVLDLWTLRARAATPGEKLTLPEIGRVLYHINQKRGYRHSRSDDSADKEQREYVQAINKRFQEIREEGVTIGQHFVKKLKESEVVTDKGAFYNYRIKEQVFPRDAYVAEFDRVMDCQKVFYPEELSEANINEFRNEIIFYQRNLKSCKHLVSRCEFMTRSFLDEEHRPVLDASGKLVISGPKVAPKSSPIFQVCKIWEEINNLSIRNKENDELHISPEQKKEIFEYLDNNEKITSAALYKILGISKGDGWSVDKALSKGFTGNTTKVAISKALGKANDAKKRDLLRFDLRLKENGVNKDTGEIICEIDPECENEPLYKLWHVIYSINDKDAQRHALTSQFGINDEASLAELSKIDFVKQGYGSRSVKFMRKLLPSLMDGAKYSEACDVIGVNHSGSLTKSENEARELLQRIPQLQKNELRQPVVEKILNQMINVVNAVIEKFGGVDEIRVEMARELKLSKEGRAATAKNIRDREKENKEIAEKIIELGVTPSKNKILKYRLWQEAGQKCFYCGQPVGATEFLNGLDVEIEHVVPKTLLFDDSFSNKVCACRKCNAEKRNSTAYDYMKSKGENAFNDYLRRVDTAFSEHKISFTKRSRLLTPADKIPKDFISRQLVQTQYISRKAMEILKQVCHNVYGSSGEVTSYLRRIWGYDEILHSLDLPRYREGGMTAEVSYEHRGQTHTEERIKDWSKRLDHRHHAIDALTIACTRQSVIQRLNNLSSMTAVAGEAMSLDKWTLAQPHFSVQEVSDKVGGILVSFKAGKKVTTPGERYTYRGGKRILAQDGLLIPRGALSEESVYGRISALEKNVPVKKLFERVEDIVKPGIRAVVEDRLMACDNDVNAACASLKKEPLYLDAEKTIPLEYGTCYKAKYVMKYALSALKPKDVEYIVDEHIRKVVSERLSEYGNDPKKAFAEPLYADDAETIPVRTVRCYTGLDQVVPVKRDVAGNDIGFVKPGNNHHIAIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 1323 - protein, 1159 aa, unidentified
  REGION 1..1159: note = Description of Unknown: uncultivated organism with predicted taxonomy: Bacteroidales
  REGION 1..1159: note = MG16-245 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTNELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVAETIEQTPLFRLWHAVYSLQNADELAKTLREKFEITDKAVIDALCKIDFVKPGYANKSHKFIRRLLPYLMNGYQFSEACAHIGINHSNSMTAEERDSRTLVERIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKDNATAMEYMAGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSILERWVADQPHFSVADVTNKVDGILVSFRAGKRVTTPARRAIYSGGKRKIVQTGLQVPRGALTEDTIYGKREEGFVVKYPLDHPSMKVENILDPTIQNLVKEHIAAFGGNAKEAFKMPLFSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERQDYNLLNKHLYRVQKISSKDYSFRYHTETKVDDKYDGIENGRSTSMSLGALFRFKSINGLFSQFPHKVKIDIMGRITKA

SEQ ID NO: 1324 - protein, 972 aa, unidentified
  REGION 1..972: note = Description of Unknown: uncultivated organism with predicted taxonomy: Bacteroides sp. CAG:770
  REGION 1..972: note = MG16-246 effector
SYTIKKDGKEITIGPKVAPRTSPLAQLSSFLETANNITIRNKRNDELYISPEQRKAIADFLDNNEVMKLTDLYKILNIGRKDGWWAGKAIGKGLKGNTTKCQIRKALSNFPKDQINSLTAFQLEFDEYVDEETGEVLKRVNNTQAEKQPLYRLWHLLYSIKDVDELSGALRHLGIEDEESITKLCNLDFRTAGYANKSAKAIGRILPYLMEGMMYSDACERAGFDHSRRINPDRDLLKSLPQIQKNELRQPVVEKILNQLVNIVNALLEKEGIIDEIRVELARELKQSKDERNEAFKRNNQNERQNKEYAERIKEYGLTPTRNRIMKMKMWEESEYTCMYCGQPVNVTEFLQGADVEREHIIPRALLFDNSFTNQVCSCRRCNSQKGMRTAYDFIEDDKGQEGLNAYIERINDLFNRKKISRSKFNRLLVSHKAYISRKAQGKETEENKELWENFIDRQLRQSQYIARKSVEMLQQVCKDVYTTSGSVTDFVRHQWGYDEILHDLNFERFKKAGLTTMVTQLHSGKEVEVERIKDWTKRLDNRHHAVDALAIACTTQGMIQRLNTLNASREGILDELNSKEERVVDPERSMLEKWIYTQPHISYAQAKEAIDNIIISQRPNIRITVPGKRYITKNGKRTLAQTGIIVPRGALHAEFVYGRIMKQGADGVTLTPQYVRKYKLGIGAQGFLFNGKEFYKEELKKDSKTDLSSIIVTDKIKDVLEKVVDGGIRQRILERLNRGFEEGTDYRANVAQALANLKNLDEDPIFSDDAKTRPIRTVRKYVSSSTMVAVRKDCNGKPIAFVEPDGNHHVAIYKDENGMITESIVTKWQAVQRKLNHIPVIIDNPSQTWSEIMGKNDVPEELLQTLPKDKSTLLLSLQIGEAFIMGMDDAEYQKAVEEKDMQALAEHLYFVQSISSSDYRFRRHIESQYDTNDINKEDLRFLRIRKIQALFEYNPQKVKVTVLGDIILLNT

SEQ ID NO: 1325 - protein, 1162 aa, unidentified
  REGION 1..1162: note = Description of Unknown: uncultivated organism with predicted taxonomy: Porphyromonas sp. oral taxon 278
  REGION 1..1162: note = MG16-247 effector
MKKRILGLDLGVGSIGWALIETTDNKPEQIVGMGCRIVPISKDDNDQFSKGQAISKNADRTARRTARKGYDRYQLRRALLTQVLRQNGMLPDRMDENAIDLWKLRSDAATEGEQLTLPQIGRVLYHINQKRGYKHAKSDDNGDKKQTDYVAAVNQRYVDLQAEDKTIGQHFYLELLNSRVEGVNGPYYTFRIKDKVFPRAAYIAEFDQIMRVQQPFYPDVLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1326 - protein, 863 aa, unidentified
  REGION 1..863: note = Description of Unknown: uncultivated organism with predicted taxonomy: Coprobacter sp.
  REGION 1..863: note = MG16-248 effector
KLDITLEQRKQMVEFLCTNKELKLTNLYKILGISKKDGWYGGKAIGKGLKGNATLLQLREALGGKYDKWLEMPVELKDSKWVDTETGEVIKEVAETVEQTPLFKLWHAVYSLQNEDELAKTLREKFQITDAIVIDALCKIDFVKPGYANKSHKFIRRLLPYLMAGYQYSEACAHIGINHSNSMTKEEREARPLTEQIELLHKNALRQPVIEKVLNQMINLVNRLQQEYGPIDEARVELARELKQSREERDSAYKAINKNERDNAAIAAKIAEFGVRPSRSRIQKYKMWEESNHRCFYCGKIMDITQFLNGADVEIEHIIPRSILFDDSYSNKVCACRDCNHEKDNSTAMEYMESKPAGEFEAYKQRVDEAFSAHRISKTKRDHLLWRRGDIPQDFIERQLRQSQYIAVKAVEILQAGIRHVWTSGGSVTDFLRHQWGYDEILHTLNLPRYRKVDELTEIVHFEHAGQEHEEERIKNWTKRIDHRHHAIDALTVALTQQSYIQRLNTLEASHDWMEKQVKEVNTPYNEKKSVLERWIADQPHFSVSDVTDKVDGILVSFRAGKRVTTPARRAIYPGGKRTIVQTGLQVPRGALTEDTIYGKREEGFAVKYPLDHPSMKAENILDPTIRRLVEERIAAFGGNAKEAFKTPLYSAKGMEIKSVRCKTNLSENGVVPVKRNALGQPIGFAKKGNNHHVAIYKTGNEKPFDQVVSFWDAVERKRYGVSVVIDNPREMWNGLLNKELPQDFLNKLPHDDWQFVLSMQENEMFVLGMENDEFNDAIERHDYNTLNKHLYRVQKIAHNDYWFRFHIETSVDDKYGDKEKQVLNMAWSTELKKVYRFNSQGALFAQFPHKVKIDIIGRITKV

SEQ ID NO: 1327 - protein, 970 aa, unidentified
  REGION 1..970: note = Description of Unknown: uncultivated organism with predicted taxonomy: Bacteroides sp. CAG:144
  REGION 1..970: note = MG16-249 effector
ISQCEFAMREYTTADGKRIQAGPKVAPRSSPLFQVCKIWESVNNIEMKNRNGESYPFSEEERLKLFNFLDNNEKLTVTDLKRILGLSVKDKWWGGKAIGKGLQGNTTKIALKKALQGHEGLLSFHLKTVDSRHIDTETGVILQEIAPGFEKEPLYRLWHIIYSIKEPDEMASALKQQFGIEDPEVLSRLAKIDFVKAGYGNKSARFIRQILPYLQKGLKYSEACDYISINHSNSLTTAENKSRKLQPRMQQLQKNELRQPIIEKILNQMVNVVNALLDKHVSIDEVRVELARELKQSRDERNSTFLNNSKRERENKIISERIQEMGIRPSRNRIQKYRLWEESKHICFYCGQPVGVREFMEGVDVEIEHIIPRSLFFDDSFSNKVCACRKCNAEKGNRTAYDYVKKKGENEFADYTRRIEEAFEKKEISKTKRERLLTSAKDIPEDFIDRQLRQSQYISKKAVEMLKQVCRNVWTTSGSVTDFVRHQWGYDNILHDLNFKRYKDAGQTEIIVCDQMGQVRQVERIKDWTKRLDHRHHAIDALTIASTKQSYIQRLNHLNASRDQMFQELETQSNKVREEYSLLENWMKERPHIPVSVVSQIVDGILVSFKTGKRLTTPGKRYTYKGGKREIAQSGIIVPRGALSEDSVYGVISCLEENVPVKKLFEHPDIIFKPYIRTKVENRIKEYDGDWKAALKSLKKAPIFLGDGETKPLEYATCWKKEYVIRYPLASIQKKDVKYIVDQHIRQLVSERLNAVGEKDAFKEPLFSDKAEKNPIKSVRLFTGLTHNSLSPVKYLDGFPIGYSKPGNNHHFCYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 1328 - protein, 758 aa, unidentified
  REGION 1..758: note = Description of Unknown: uncultivated organism with predicted taxonomy: Sediminibacterium sp. C3
  REGION 1..758: note = MG16-250 effector
MYSEACERAGFDHSRRIDPNRTLLTHLPQIQKNELRQPVVEKILNQLVNIINALIEKEGAIDEIRVELARELKQSKDERNETFKRNNQNERQNKEYAERIKEYGLTPTRNRIIKMKMWEESEYTCMYCGQPVNVTEFLKGADVEREHIIPRGLLFDNSFTNQVCSCRRCNSKKGMRTAYDFIADDKGQEGLNAYIDRINNLFDKKKISRSKLNRLLVSHKAYISRKAQGKETEEDKELWENFIDRQLRQSQYIAKKSVEMLQQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDVMLEELSSNDQRLVDPERSMLEKWIYVQPHISYAEAKNEVDKIVISQRPNTRITVPGKRYVTKNGKRTLAQTGIIVPRGALHAEFVYGRIMKQEADGFTMTPQYVRKYKLGIGAQGFLFNGKEFYKEELKKDSKTGLSSIVVTDKIKDVLDKIVDGGIRKRILERLNRGFVGGADYRANIAQALANLKNLDEDPIYSDDAKTRPIRTVRKYVSSSTMVAVRKDSNGKPMSFIEPDGNHHVAFYKDENGVIKESIVTKWQAVQRKLNHIPIIIDNPSQTWSEVLGRNDVPEELLQSLPKDSSTFLLSLQIGEAFIMGMEDSDYQKALEERDMRTLSEHLYFVQNISSNNYRLRRHVESSFDITDMNKEDQRFLNIKSVNSFFNNNPHKVKITILGDIIADL

SEQ ID NO: 1329 - protein, 808 aa, unidentified
  REGION 1..808: note = Description of Unknown: uncultivated organism with predicted taxonomy: Bacteroides sp. CAG:144
  REGION 1..808: note = MG16-251 effector
NALNDLDFVTPGYANLSAKAISKILPYMMEGLDYSDSCEYVGYNHSDSLTKEENEKRELLDKIPALKKNELRQPTVEKILNQTINVFNEINANFISKGERVDEVRVELARELKQSKEEREETERGIRKQQKANDGYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIIDGIEKSINYIVDKHIREVVRERINEAFPNGETYRSEAENALAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANDNYEEIGKKLYRIQNISSGDYFLRLHTDTTSDRSNSKLTKKFLRKSLMGFLNSNPHKVSISILGKMKIVK

SEQ ID NO: 1330 - protein, 936 aa, unidentified
  REGION 1..936: note = Description of Unknown: uncultivated organism with predicted taxonomy: Bacteroidales
  REGION 1..936: note = MG16-252 effector
QVCKIWESVNNLSLKNRSGEVYHFSQEERRKMFDFLDNHDKMTVTDLYKLLGISKKEGWWGGKAIGKGLQGNTTKAALAKALGERQDLLQFQLETIDSRQIDTETGEVLKTISPSFEKEPLYRLWHILYSMHERSEVAAALERQFGITAPDTVDRLFAIDFVKAGYGNKSARFIREILPYLQAGMQYSQACDYIGINHSNSLTIEENASRVLLDRLPQLQKNELRQPVIEKILNQMVAVVNALLSQYGPIDEIRVELARELKQSRDERNDAYLSINKRERENKVIEERIREYGISPSKSRIQKYRLWEESNHLCFYCGHPVGAAEFLSGSGVEIEHIIPRSLLFDDSFANKVCACRKCNAEKGNSTAFDYMKSKPANDFEDYLKRVEKYFTEKRISKTKRERLLTPASEIPQDFIDRQLRQSQYISKKAVEMLKLVCRNVWTTSGSITDFLRHNWGYDQILHDLNLPRYSLGGMTESVHYEHNGQKHEEERIIGWTKRLDHRHHAIDALTIASTQQSYIQRLNTLSASRDVMHAEVEKQGVQWQEKHSLLEEWTAQRPHLPYSTVRDYVDGILVSFKPGKKVATPGKRYTYKNGKKELVQDGLLIPRGALSEESVYGQITTIEPSVPVKKLFEDPSLIFKPYIRELVERRIKECGGDWKKARASIGKKPIWLDTEETVALEFATCWKKEYVMKYPVSSLKAKDVDSIVDRHIREIVRRRIDEVGEKEAFKTPIYTDDAQSIPLRSVRLFTGLDAVEPVKYVDGVPVGFSKPGNNHHIAIYRDKDGNRSEHVVSFWHAVERKRYGLPVIIRDTDSVWDQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPHKVRISVTGELIPIQ

SEQ ID NO: 1331 - protein, 851 aa, unidentified
  REGION 1..851: note = Description of Unknown: uncultivated organism
  REGION 1..851: note = MG16-253 effector
KLKDVHEVLGINSKSGWYCDKAIKSGIKGNSTKCAIISALSSLPNSIIREITRFNLETETSNMVDEETGELLVRIKSTYQEEPLYRLWHIIYSIKNDAERLNTILVFLKEFGIEDVSIANALNDIDFVTPGYSNLSAKAISKILPYMMEGLDYSESCEYVGYNHSDSLTKEENEKRELLDQIPAIKKNELRQPTVEKILNQTINVFNQINADLGKKGERVDEVRVELARELKQSKEEREETDKGIRKQQKANEEYADILKKKGVRPTRNRILKYRLWKESEEACFYCGRDIDFHEFLRFSDVEREHVIPKKLLFDDSFANQVCSCRRCNAEKGGRTALDYMRTKPNLQEYLDKVDKLFQEHKIGGKKHAHLLASYDDYLSRKKEGKETKDDIMIWEEPIDRQLRLSQYISKKAQELLKAACREVMATSGSITDLIRHTWGYDTILHELNFPRYKDAGLTEIIKDEETGMQREVIPDWSKRLDHRHHAIDALAVACTSRSIVQRINTLNASREIIREEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGAGSVGFVFTGKETCDVVFDKKNERYVIVDGIGKAINYIVDRHIREIVRERINEAFPDGETYLSEAEKALAEGRLYNSKDRCQKALEQLKSLDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTF

SEQ ID NO: 1332 - protein, 919 aa, unidentified
  REGION 1..919: note = Description of Unknown: uncultivated organism with predicted taxonomy: Marinilabiliaceae
  REGION 1..919: note = MG16-254 effector
NRIIFYQRPLKSCKHLVSLCEFEARPYKTKDGKIVYGGPKCAPRTSPLAQLCAMWETANNITLTNRNNERFEFTLDQRRQIVDFLCHNKEMKVTHLQKILGISKKDGWYGGKAIGKGIKGNATLNQLREALQGKYDQWLEMPIKHIDVVDATTSEVFWAVSPEVEETPLFKLWHAVYSLQNADELAKTLREKFQITDEAVIEALCKIDFVKPGYANKSHKFIRRLLPYLMEGMMYSEACERININHSNSMTREEREQRPLSARIQLLQKNQLRQPVVEKVLNQMINIVNSLKDQYGEIDEARVELARELKQSRDERESAYKAMGQNERRNKEIAEKISEFGIRPSRSRIQKYKMWEESLHQCFYCGKTIDLSEFLNGADVEIEHIIPRSILFDDSFSNKVCACRRCNQEKGNQTAMEYMETKSAAEQEAYKQRVDEAFTAKRISKTKRDHLLWRKTDIPADFIERQLRQSQYIAVKAVEVLQDGIRQVWTSGGSVTDFLRHQWGYDEILHTLNLPRYRQVEGLTELVDFEHAGQKHTEERIKNWSKRIDHRHHAIDALTVALTQQGYIQRLNTLEASHDFMEKQVKEAGTKYNEKKSILEKWINEQPHFSVEEVTNAVDRILVSFRAGKRVTTPARRAIYKGSKKTIVQTGLQVPRGALTNDFVYTKHGKKYARKYPINAISNPENIVDATIRQLVKARLASHGGNINDAFKTPLYSAEGMEIKTVRCYNNKLSDRGVVAIKYNEQKEPIGFAETDNNHHMAIYKLADGSLKERVVSFWDAVERKRYGLPIIITNPNEVWSIVLEKDLPQDFLNKLPEDKWEYVLSLQENEMFVLGMEDDEFNDAIDTHDYNLLNKHLYRVQSISYGDYYFCHHTETKATDKNESIKLGKTLRIRGVNSLKSYFPHKVQVDLLGHIHKV

SEQ ID NO: 1333 - protein, 1221 aa, unidentified
  REGION 1..1221: note = Description of Unknown: uncultivated organism with predicted taxonomy: Bacteroidetes
  REGION 1..1221: note = MG16-255 effector
MKRVLGLDLGVGSVGWALVEKDERNIPINVNKIGSRTVPLSNDEENNFSKGAAIPTNKDRTIKRTARKCNNRYKLRREQLTNGLRALKMLPDETLFKLDPLQLWELRAKAATEKVSLPELGRVLYHLNQKRGYKHSKDNEQDSKQTDYVATVNKRYKDLQSKNLTIGQYFAQKLKESEHIQEGGKSYSFRIKDNVYPRAAYEEECKRILSTQKQFYPDILTDNNVKDLFQFIYYQRPLRSCKHLISRCSLEEQLHDVKEKDFYAPKVAPISSPLAQLDKIWEAVNNFTVRGKRNEELYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPLYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTVKEHVCTNWHAVQRRMYGFPAIIDNPSDAWQQASNNDKLPEDLLMHLPDDNSKFLLSMQIGDAFILGMEEYEYQAAINEKNYKLLGEYLYFVQKLSSNDYAFRRHVESKYEEKQTNKDDGRFIRIRSIDKYENYNPHKVKITLLGEIFP

SEQ ID NO: 1334 - protein, 829 aa, unidentified
  REGION 1..829: note = Description of Unknown: uncultivated organism with predicted taxonomy: Bacteroides sp. CAG:144
  REGION 1..829: note = MG16-256 effector
ERLHSIIRFLKDFDVEDILIANALNDLDFVTPGYANLSAKAISKILPYMMEGLGYSDSCEYVGYNHSDSLTKDENEKRELLDKIPALKKNELRQPTVEKILNQTINVFNEINANLISKGERVDEVRVELARELKQSKEEREETERGIRKQQKANDEYAKLLKEGGVRPTRNRILKYRLWRESNETCFYCGQPINFNEFLKFSDVEREHVIPKKLLFDDSFANQVCSCRKCNAEKGGRTAFDYMRTKQNLQDYLDKVDKMFQEHKIGGKKHSHLLASYDDYLSRKKEGKETKDDVKIWEEPIERQLRLSQYISKKSQELLKMACRNVVATSGNITDLVRHTWGYDTILHELNFPCYKEAGLTTFIKDENTGQQREVIKDWTKRLDHRHHAIDALAVACTSRSIVQRINTLHASREEMREDVKSPRKDWEDNDLLQQWIKEKMPFDRDYVLHKVASILVSMKAGKKATVPGKRKIYKNGKPITVQSRLRIPRGQLHEQTVYGAIKQYSKDKKGNVIESREIVTRYKMGVGSVGLVFNGKETCDVIYNKKKECYEIVDGIEKSINYIVDKHIREVVRERINEAFPNGETYRSEAENAFAEGRVYNGKERCQKALEQLKSLDEHPLYADKNHHIVIKSVRCFTGLGAVQPLRYNNDNEPISFVLTKNNHHVAIYADENGDYKECIYTFWQVVERSKYKLPLIIKDPKALWEEIRQRENNGERFPDTLIASLPSPNWAFVESLQLNDMFVLDIDDEDFENFIANENYEEIGKKLYRIQNISSGDYFLRLHTDTTSDRSNSKLTKKFLRKSLMGFLNSNPHKVSISILGKMKIVK

SEQ ID NO: 1335 - protein, 1159 aa, unidentified
  REGION 1..1159: note = Description of Unknown: uncultivated organism with predicted taxonomy: Bacteroidia
  REGION 1..1159: note = MG16-257 effector
MIKHILGLDLGVGSIGWALIETENDQPKQIIGIGSRIVPLSKDDSDQFSKGQAISKNADRTARRTTRKGYDRYQLRRALLTQVLRQNGMLPERMDENVIDLWKLRSDAATEGHQLTLPQIGRVLYHINQKRGYKHAKADNNGDSKQTKYVETVNQRYAEIQETGQTIGQHFYLELLHSKVESGNGPYYTYRIKDKVFPRAAYIAEFDQIIKVQKAYYPEVLTDELIDTLRNRIIFYQRPLKSCKHLVSLCEFEMKPYKTKEGKIVYGGPKCAPRTSPLAQLCAMWETANNITLTNRNNEQYDFSLDERRQLVEHLCTHEVLKLTDLYKILGITKKDGWYGGKAIGKGIKGNATLNQLRKALNGKYGEWLEMPIEHIDAVDNETAEVFWQVSPKVEETPLFRLWHAVYSIQDADELAQTLRNKFGITEQEVIDALCKIDFVKPGYANKSHKFIRRLLPYLMDGMMYSEACKLLRINHSNSMTTEERDARPLAERIELLPKNALRQPVIEKILNQMINLVNRLQQEYGPIDEARVELARELKQSREEREGAYRRNNQNERLNKEIFAKIEEMGIRPSRSRIQKYKMWEESNHRCMYCGKTVSLAEFLNGAEVEIEHIIPRSILFDDSFSNKVCACRECNHEKGNLTALDYLETKPTAEQEAYKQRVDEAFKEGRISKTKRDHLLWHRSDIPTDFIDRQLRQSQYIAVKAVEILQQGIRQVWTSGGSVTDFLRHLWGYDEILHTLNLPRYRQVEELTEIVHYEHAGQEHDEERIKNWSKRIDHRHHAIDALTVALTRQAYIQRLNSLNAEFTREEMLKEVEEANTVYNEKKSLLEKWVNEQPHFSVDDVTQSVDSILVSFRAGKRVTTPARRAIYQGGKRTIVQRNIQVPRGALTNEFVYTKNGNKYARKYPIDAISNPENIVDPTIRQLIKARLAAFNGNAKEAFKEPLFSAEGMEIRTIRCYNNKLADKGVVAVKYNERQEPIGFSETDSNHHIAIYRDKSGKYQEMVVSFWDAVERKKFGVPVVISNPHDVWDSIMDKDLPQEFLVKLPKDDWTYILSMQENEMFVLGMEEDEFNDAIEAKDNAVLNKHLYRIQNISSLFYNFRYHTETKVDDKYAGIENGRNASMSLGALVPIRSFGSLFALFPHKVKIDIMGRITKA

SEQ ID NO: 1336 - protein, 943 aa, unidentified
  REGION 1..943: note = Description of Unknown: uncultivated organism with predicted taxonomy: Bacteroidales
  REGION 1..943: note = MG16-258 effector
VLTDELIDTLRNRIIFYQRPLKSCKHLVSLCEFEMRPYKTKDGRIVYGGPKCAPRTSPLAQLCAMWETVNNITLTNRNNEKLDITLDQRKQMVDFLCSNKELKLTNLYKILGISKKDGWYGGKAIGKGIKGNATLLQLREALGGKYDQWLEMPIELKDSKWVDAETGEVMKEVTEAVEQTPQFRLWHAVYSLQNVDELAKTLRTTFQITDEAVIEALCKIDFVKPGYANKSHKFIRRLLPYLMDGYQYSEACAHIGINHSNSMTAEERDERPLAERIELLPKNALRQPVIEKILNQMINLVNRLQQEYGPIDEARVELARELKQSRDERDSAYKAINKNERENAAIAAKIAEFGIRSSRSRIQKYKMWEESSHRCFYCGKTMDITQFLSGADVEIEHIIPRSILFDDSFSNKVCACRECNREKGNMTAMEYMEHKPAGEFEAYKQRVDEAFTDHRISKTKRDHLLWRRADIPQDFIDRQLRQSQYIAVKAVEILQTGVRRVWTSGGSVTDFLRHQWGYDEILHTLNLPRYRQVEALTEIVHYEHAGQEHNEERIKNWTKRTDHRHHAIDALTVALTQQSYIQRLNTLEASHDWMEKQVKEANTPYNEKKSVLERWVADQPHFSVAEVTDKVDGILVSFRAGKRVTTPARRAVYRGGKRTIVQTGLLVPRGALTEDTIYGKCEDGFVVKYPLDHPTMKPENIVDPTIRRLVEKRIAAYGGNTKEAFKTPLYSAEGMEIKSVRCLTNLSEKGVVPVKYDKTGQPIGFAKKGNNHHVAIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 1337 - protein, 921 aa, unidentified
  REGION 1..921: note = Description of Unknown: uncultivated organism with predicted taxonomy: Prevotella saccharolytica
  REGION 1..921: note = MG16-259 effector
FVNNIRLENGYKEARALSQDERLKVVDYLDNHEKMTARDFTKLLGLDKNDEWDLKKYFGKNGVQGNITKTQLATALANVSNASELLRFNLALENSNYVNESTGEVLKVISSDFQNEPLYMLWHTVYSLSDKEELKNALNKKYGITDESVLNNLFKIDFVKPGFGNKSAKAIRRILPFLQDGLVYSDACAEAGYNHSNSLTKSENEARTLLSRLPQIKKNELRQPVIEKILNQMVNVVNAIYDEYGQIDEIRVELARELKQSKDERNTTASNIAKRERENKNIEAKIQEFGIRSSRNRIQKYRLWEESEQKCFYCGQPVQAKEFLSGLDVEVEHVIPKSLLFDDSFANKVCACRKCNAAKGNKTAYDFMKGQKEEVFDAYVKRVNDFYKDGKISKTKKERLLTTQSEIPSDFIERQLRQTQYIAKKALEMLKDVCYNVYATSGSVTDFIRHTWGYDEILHQLNYDRYKKGGLTEFREYDHKGETHTEERIQDWSKRLDHRHHAIDALVIAMTRQSIIQRLNHLNTERDAMFQEVEKQRKEWKNDYSMLQEWLRERKHFSAEDVAKKVSDILVSFKAGKRVATIGKRVKYEHGKKNVLQTGIVIPRGPLSEESVYGKIKVLDRNKPVKHLFENPESIVNADIKSAVTNRLIQNKSDVKKAVQSLKKSPIVLANGKTLENADCYKEEYVIKYSLNGFKAKDIDSIVDTHIKDVLYKRLEEYNGNEKEAFKDIENNPIYADAAHKIKIRNVRCFTGLSAVVPVKKDENGNAIGFVKPGNNHHVAIYKDENGNLQESVATFWHAVERKKYGLPIVITNPIDAWKLARERNCPKEFLDCLPKENWTFVQSLQINEMFVMGLTNEAYEKAVAEKDYALLNQYLYRVQKLTSNDYFVRYHLETVLDDSAEARSIKKFYRFKSLGSLFKE

SEQ ID NO: 1338 - protein, 777 aa, unidentified
  REGION 1..777: note = Description of Unknown: uncultivated organism with predicted taxonomy: Bacteroides sp. CAG:770
  REGION 1..777: note = MG16-260 effector
LYITHEQRSAIVEHLEHNKDIKLTAIQKILGIGKSKEWFIKKEQLKPLQGDITRIKLAEALSSGHLSKEKIENLLLLKIDFEEMADTTTGEVMGGIVVKNNIESQPFYQLWHAIYSIDDEKALRKTLAKLGIDDDDVMDALCKISFKTSGYAKKSTRAIKKILPYLMEGYQYSDACQMAGYNHSNSITKEEEASRPLQDHIPQIQKNELRQPVVEKILNQMINIVNTLLKDGPIDEIRVELARELKRSKDEREMANIRMNRNKRRNDEIASIIQNEYGLIPTKNRIMKYKMWEETDGFCIYCGTKIKLAEFLGGVDSEREHIIPKSLLFDDSFSNQSCACRKCNKEKGNRTALDYMRDIGKEKQYVEHIAELLEKDKISKTKYSNLLASYKDYLERKAKGKETEEDKNLWENFIDRQLRLSQNIARSAMELLRQVCHNVYATSGSVTDFVRHQWGYDNILHDLNFSRFAKSGNTEFITVVGADGKETQQERIKGWSKRMDNRHHAVDALAIALTTQSMIQRINNLNASREFMQKDVEASKEKFKEKKSLLEKWVAIQPHLSYGQAKDAISGILVSQRSGKHITTPGKRYEYKGGSKILRQQGLVVPRTALHDEFVYGRISRYDKNGILQPEIVRKYGILGGMGCLFDGKETYKETEKTDKKIGLPKIKIEDKIKDVLDKIVDGGVRKRILERLNRGFEEGKDYRNDTKKALDNLRNLDEDPIYLDDAHTIPIKTVRKFTHSTKAIPLRYNDKNEPIAFVEPGGNHHVALYETADGTV

SEQ ID NO: 1339 - protein, 934 aa, unidentified
  REGION 1..934: note = Description of Unknown: uncultivated organism with predicted taxonomy: Bacteroidales
  REGION 1..934: note = MG16-261 effector
ATEGHKLSLPELGRILYHINQKRGYKHAKADEAGDKQQTEYVAAVNSRHAMIKERHQTIGQYFAEEIRKSEIISEKGKFYTFRTKEKVFPRKAYEEEFDKIIATQRQFYPTVLTGTTINRLRNEIIFYQRKLKSCKHLVSLCEFEKHEYKNKEGKTVFDGPKVAPRTSPLAQICRIWEFVNNISLENGYKERKELSLEEKQKVVNFLDNNDKMTATDFSKLLGLGKKNGWDLKRYFGKNGVKGNETKVSLRNALKNLPNVEDLLRFNPTLDNSNYVNEATGEVLKVISPSFQNEPLYELWHTVYSLSDKDDLSNALNKKFGISDENAVQKLFKIDFVKPGFSNKSAKAIRRILPFLQQGLMYSEACAEAGYNHSNSLTKTGNEARVLLERLPQIKKNELRQPVVEKILNQMVNVVNAIYDDYGAIDEIRVELARELKQSKDERNTTFNNIAKRERENKGIAERIKNEYGLIPNRNKIEKFRLCEESDHKCFYCGQAVNAKEFLLGSDVEVEHVIPKSLLFDDSFANKVCACRKCNAQKGNKTAFDFMKSQSEDEFNNYVSRVEEYYKNGKISRTKHDRLLTPQTEIPSDFIERQLRQTQYISKKALELLREICHNVYATSGSVTDFIRHTWGYDEILHQLNFDRYKQSGLTEIREFDNKGEIHKEERIQKWNKRLDHRHHAIDALVIAMTKQSIIQRLNHLNTERDAMFQEVEKQSIEWKNDFSLLQEWLRERKHFSTKDVANRVANILISFKAGKRVATIGKRIKYEKGQKKVLQEGIVIPRGALSEESVYGKIKVIDPHKPLKFLFENPQTVISPQIKAAVVNRLSKFENDFKKTIVSIKKEPLTLASGKVINDADCYKEEYVIKYPLEGFKAKDIPYIIDKRIREVVEKRLSEYDGNEKNAFKDLENNPVFVDANHKISIKHIRCFTGLSA

SEQ ID NO: 1340 - protein, 821 aa, unidentified
  REGION 1..821: note = Description of Unknown: uncultivated organism with predicted taxonomy: Porphyromonas catoniae
  REGION 1..821: note = MG16-262 effector
SIGWCLIEKDDNNVPKRILRIGSRIVPISSDEETGYTKGNAISKNADRTAKRTARKCYDRYQLRRQALVNLLKRLGMEPNKNLMLEQTPMELWQKRADAASKEISLEELGRVLLHINQKRGYKHSRLSNSDSKETAYVQEVNSRYNDLKAEGLTIGQHFAAKLKENEQKSTDGKKYYNYRIKEQVYPRHAYEEETKKILEVQSRYHSDVLTPDVRNEMMETIFYQRDLKSCKNLVSLCEFESYTITKDGKEITIGPKVAPRTSPLAQLSSILETANNITIRNRRNDELYISPEQRKAIADFLDNHEVMKLTDLYKILNIGRKDGWWAGKAIGKGLKGNTTKCQIREALSALPKEQVDSLTAFQLEFDEYVDEETGEVRKRINNTQAEQQPLYKLWHMLYSIKDNTELSGALNHLGIEDNESIEKLCKLDFRTAGYANKSAKAIGRILPYLMEGVMYSQACERAGLDHSRRIDPNRPMLKRLPQIQKNELRQPVVEKILNQLVNIVNALLEEEGAIDEIRVELARELKQSKDERNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFDRFKKAGLTAMVKQLHSGKEVEVERIKDWTKRLDNRHHAVDALAIACTTQGMIQRLNTLNASRDEMLEELNGK

SEQ ID NO: 1341 - protein, 973 aa, unidentified
  REGION 1..973: note = Description of Unknown: uncultivated organism with predicted taxonomy: Sediminibacterium sp. C3
  REGION 1..973: note = MG16-263 effector
MLKRLGIEPNKKLMLEQAPLELWQKRADAVSTKIALEDLGRVLLHINQKRGYKHSRLNNSDSKETAYVQEVNNRYDELKAEGLTVGQHFAAKLKDNEQTSADGKKYYNYRIKEQVFPRHAYEEEAKKILETQSRYYPDLLTPDVCKEIMNIIFYQRDLKSCKNLISYCEFESYTITKDGKEITIGPKVAPRTSPLAQLSSILESANNITIRNRKNDELYISPEQRKALADFLDNHEVMKLSDLYGILNIGRKDGWWAGKAIGKGLKGNTTKCQIREALKNLPQEKINALTSFNLEYDEYVDEETGEVRKRVNNHLAERQPLYRLWHLIYSIKDSDELAAALRRFGIDDEESILNLCNLDFRTPGYANKSAKAIGRILPYLAEGVMYSDACNMAGFDHTRRLNPNRPLLTSLPQIQKNELRQPVVEKILQQVVNIVNTLIEKEQSIDEIRVELARELKQSKDERNETFRRNSQNEKKNKEFAEHIKEYNLTPTRNRILKWKLYEESDHSCMYCGQSINIRDFLQGADAEREHIVPRGLLFDNSFTNQVCACRSCNSKKGMRTAYDFIEDEKGEEGLHSYIEHINYLFNKKNISRSKFNRLLVSHKAYLKRKALGKETEEDKELWENFIDRQLRLSQYIAKKSVEMLQQVCRNVYSTSGSVTDFVRHQWGYDELLHDLNFERYKRAGLTAMVTQLRSGKEVEVERIKDWTKRLDNRHHAVDALAIACTTQGMIQRLNTLNASREDILDELNKTEERNDDSERSMLEKWICSQPHISYAEAKDELDKIIISQRPSTRLTVPGKRYVKKDGKRTPVQAGILVPRGALHAEFVYGRIMKYGADGVTLTPQYVRKYKMGIGAQGYLFSGKEFYKEEQKKDSKTGQTSTVVTDKIKEVLDKVVDGGIRRRILERLNRGFEDGKDYRSNVPQALANLKNLDEDPIYSDDAKTRRILTVRKYVASSTMVAIRKDADGKPLAF

SEQ ID NO: 1342 - protein, 906 aa, unidentified
  REGION 1..906: note = Description of Unknown: uncultivated organism
  REGION 1..906: note = MG16-264 effector
QDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYAGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTEFDFMRSQDKAVFDDYIKRVEKWFDDGIISPSKRERLLLSHEDYLERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKRKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKRNEQGEPIGFVKPGNNHHIAIYRDKEGQLQEHTVTFWHAVERKKYGLPVIIENPTEVWDSIMDRQLPESFLEKLPDVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1343 - protein, 992 aa, unidentified
  REGION 1..992: note = Description of Unknown: uncultivated organism
  REGION 1..992: note = MG16-265 effector
MNIIFYQRDLKSCKNLVSLCEFESYAITKNGKEITIGPKVAPRTSPLAQLSCILETANNITIRNRKNDELYISPEQRKAIADFLDNHEIMKLTDLYKILEIGRKDGWWAGKAIGKGLKGNTTKSQIRKALSSLPKEQVDSLTAFQLEYDEYVDEETGEVRKRINNALAEKQPLYRLWHLLYSIKDVDELSGALRHIGIEDDESIQKLCNLDFRTAGYANKSAKAIGRILPYLMEGLMYSEACERAGFDHSRRINPERTLLTSLPQIQKNELRQPVVEKILNQLVNIVNALLEKEGHIDEIRVELARELKQSKDERNETFKRNSQNERKNKEYAERIKEYGLTPTRNRIMKMKMWEESEHSCMYCGQPVDVKEFLQGADVEREHIVPRGLLFDNSFTNQVCSCRRCNSQKGMRTAYDFIEDDKGEAGLNSYIEHINYLFDKKQISRNKFNRLLVSHKAYINRKAQGKETEEDKELWENFIDRQLRQSQYIAKKSVEMLQLVCRNVYTTSGSVTETVRRLWGYNELLHDLNFERFKKAGLTTMVTQLHSGEEIEVERIKDWTKRLDNRHHAVDALAIACTTQGMIQRLNTLNASRDDMLKELNSQEQRVVDPEHSMLEKWIYTQPHISYVQAKEAIEKIIISQRPNTRITVPGKRYVTKNGKRTLVQTGIVVPRGALHAEFVFGRIMKQEADGKILTPQYVRKYKLGIGAQGFLFNGKEFYKEELKKDSKTGLSTIVVTDKIKDVLEKIVDGGIRKRILERLNRGFGEGTDYRANVAKALDNLKNLDEDPIFSDDAKTRPIRTVRKYVSSTTMVAVRKDSEGQPLAFVEPDGNHHVAFYKDEDGVITESIVTKWQAVQRKLNHIPIIIDNPSQTWNEVIGRNDIPDELLQTLPKDKSTLMLSLQIGEALIMGMEEADYQKAIEEKNMLALAEHLYFVQNISIGNYRLRRHVETSYDVKDMNKEDLRFLNIASIAALFNYNPHKVKITVLGDIIP

SEQ ID NO: 1344 - protein, 960 aa, unidentified
  REGION 1..960: note = Description of Unknown: uncultivated organism with predicted taxonomy: Porphyromonas sp. oral taxon 278
  REGION 1..960: note = MG16-266 effector
RKHQMLPDEHLIKLPVLDLWTLRANAATEGFKLSLPEIGRVLYHINQKRGYKHAKADEAGDKKQTEYVENVNKRFAMIKDLGLTIGQFFASKLKESEVVSEKGKFYTYRTKEQVFPRGAYIAEFDQIIEVQRKFYPQVFTDEFINRLRNEIIFYQRNLKSCKHLVSLCEFEKHEYKNKDGKIVFDGPKVAPRTSPLFQICRIWEFVNNIRLENGYKEARTLSQDERLKVVDFLDNHEKMTAKDFTKLLELNKNDEWDLKRYFGKNGTQGNTTKTQLATALANIPNASELLQFNLTLENSNYVNEKTGEVLKVVSSDFQNEPLYMLWHTVYSLSDKEGLKNTLNKKYGITEESVINNLFKIDFVKPGFGNKSAKAIRRILPFLREGLVYSDACVEAGYNHSDSLTKSENEARTLLSRLPQIKKNELRQPVIEKILNQMVNIVNAIYDEYGQIDEIRVELARELKQTKDERNTTASNIAKRERENKNIEAKIQEFGIRSSRNRIQKYRLWEESDQKCFYCGQPVQAKEFLSGLDVEVEHIIPKSLLFDDSFANKVCACRKCNAAKGNKTAYDFMKGQKEEVFDAYVKRVNDFYKDGKISKTKKERLLTTQSDIPSDFIERQLRQTQYIAKKAIEMLKDICYNVYATSGSVTDFIRHTWGYDEILHQLNFDRYKKGGLTELREYDHKGETHTEERIQNWSKRLDHRHHAIDALVIAMTRQSIIQRLNHLNTERDAMFQEVEKQSKEWKNDYSMLQEWLRERKHFPTEDVAKKVSDILVSFKAGKRVATIGKRVKYEHGKKIVLQTGITIPRGPLCEESVYGKIKVLDRNKPLKYLLENPQYIVNADIKFAITNRLAQYENDVKKAVQSLKKSPVVLANGKKLENADCYKEEFVIKYSLNGFKAKDIDSVVDNRIRNVLYKRLEEYNGNEKEAFKDIENNPIYADATHKIKIRNVRCFTGLSAV

SEQ ID NO: 1345 - protein, 765 aa, unidentified
  REGION 1..765: note = Description of Unknown: uncultivated organism
  REGION 1..765: note = MG16-267 effector
ILPYLMEGVMYRQAWERAGLHHSRRIDPNRPMLKRLPQIQKNELRQPVVEKILNQLVNIVNALLEEEGAIDEIRVDLARHLNKNKYQRNETFKRNNQNERQNKEYAGRIKEYGLTPTRNRIMKMKMWEESEYTCMYCGQPVNVTEFLKGADVEREHIIPKSLLFDNSFTNQVCSCRRCNSKKGMRTAYDFIADDKGQEGLNAYIDRINNLFDKKKISRSKFNRLLVSHKAYISRKAQGKETEEDIELWENFIDRQLRQSQYIAKKSVEMLLQVCKNVYTTSGSVTDFVRHQWGYDELLHDLNFERFKKAGLTAMVKQLHSGEEVEVERIANWTKRLDNRHHAVDALAIACTTQSMIQRLNTLNASRDDMLEELNSKDQRLVDPERSMLEKWVFIQPHITYADAKKEIDKIVISQRPNTRITVPGKRYVAKNGKRTLAQTGIIVPRGALHAEFVYGRIMKQETDGMTMTPQYVRKYKLGIGAQGFLFNGKEFYKEELKKDSKTGLSKIVVTDKIKDVLEKIVDGGIRQRILERLNRGFEEGTDYRANVAQALANLKNLDEDPIYSDDAKTRPIRTVRKYVSSSTMVAGRKGDNGKPVAFVEPDGNHHVAFYKDENGVITETIVTKWQAVQHKLYHIPIIIDNPSQTWSEVLGRNDVPEELLQSLPKDSSTFLLSLQIGEAFIMGMEDADYGRALEGKDVQSLAEHLYFVQNISSNNYRLRRHVESSFDTTDMNKEDQRFLNISSLDALFRINPHKVKLTVLGDIIP

SEQ ID NO: 1346 - protein, 983 aa, unidentified
  REGION 1..983: note = Description of Unknown: uncultivated organism with predicted taxonomy: Prevotella
  REGION 1..983: note = MG16-268 effector
VFKKRHNHKKFQSIREPSLFDDMDILDNDILYITQEQRHSMFEYMETHDRLKLCDVLRILGLNEHSGWYAGKAIGVGLQGNTTKNTILKALRTLPKEKRDMITRFELKITSRNEINENTGEVIRHIDSSYTDEPLYRLWHIIYSIQNDEERRNAISKFLQSFDIVDEVVVDKLCGIDFVKAGYGNKSAKAISKLLPYLMDGINYSDACEYVGYRHSDYLTKEENIDRELKDIIPAIKKNALRQPVVEKILNQTINIVNAVNRELRENGQGQVDIIRIELARELKMDRESRHRKFTQNNSRKRQNEEYADKINEHGIIPTRNRVIKYRLWEEANMQCFYCGQPINITELLRDPTIEKEHIIPKALLLDNSYSNLVCSCRKCNQEKGARTAYDYMRQKSDLDAYIKRINKLAETQKISQTKRLHLLASYEDYLVRKRLGKATEEDRNLWEEFINRQLSLSQYISRKAMEILQTGCRKVYATSGSITDIERHLWGYDTILHELNFPRYKCAGLTTVIKEEYEEGIITEKEVITNWSKRKDNRHHAIDALVIACTTQDTIQRINTLHASRDELQKETSGNPVFYSEKSTLLERWIKGKQPIPRHEVLEQVKQIAISIKAGKKVTTPGKRKTYKQGKPKLIQTGLLIPRGQLHEETIYGQINVPVKTKNGTIRQEPKSVVRYKLGCGKGFVFSGKETCKVEKDKKTDEYFITDEIDKALSYIVDKHIREVIRQRLNRPFPEGETYRTKAEQAQKDGRIYDGEEECKQALQGIRNLDIDPLFADKDGRIPILRVRCFTGLTLLQPLRYNSEGKPISFVSLGNNHHIALYKQTNGDIVEHVVTFWHAVERSTRGIPIVIKRPDDVWNDILNKPSDELPESFLNQLPYPNATYITSMQQNEMFILGMSQDEYQDAIACNNQTELCRHLYRVQSLSTNQYYFRLHIESENDKTLAGMKAGKFIRCKSIGSFLRLNPHKVTVTLLGKIIINNS

SEQ ID NO: 1347 - protein, 992 aa, unidentified
  REGION 1..992: note = Description of Unknown: uncultivated organism with predicted taxonomy: Bacteroidales
  REGION 1..992: note = MG16-269 effector
MDIIFYQRDLKSCKNLVSLCEFESHTITKDGKEITIGPKVAPRTSPLAQLSSILETSNNITIRNRRNDELYISPEQRKAIADFLDNHEVMKLTDLYRILNISRKEGWWAGKAIGKGLKGNTTKCQIREALGSLPKEQVDSLTAFRLEFEEYVDEETGEVRQRVNNTLAEQQPLYKLWHMLYSIKDNKELSGALHHLGIDDEKSINKLSNLDFRTAGYANKSAKAIGRILPYLMDGIMYSEACERAGFDHSRRINPGRTLLTSLPQIQKNDLRQPIVEKILNQLVNIVNALLEKEGTIDEIRVELARELKQSKDERNEAFKRNNQNERQNKEYAERIKEYGLTPTRNRIMKMKMWEESEYTCMYCGQPINVTEFLQGADVEREHIIPRALLFDNSFTNQVCSCRRCNSQKGMRTAYDFIADDKGQEGLDLYIERINDLFDRKKISRSKLNRLLVSHKAYVSRKAQGKETEEDKELWENFIDRQLRQSQYIAKKSVEMLQQVCKNVYTTTGSVTDFVRHQWGYDEILHDLNFERFKKAELTTMVTQLHSGKEVEVERITNWTKRLDNRHHAVDALAIACTTQGMIQRLNTLSACRNEMLDELNSKDERVIDPERSMLEKWINSQPHICYAQAKDEVDKIIVSQRPNTRITVPGKRYVTKNGKRTQAQTGIIVPRGALHAEFVYGRIMKQEADGMTLTPQYVRKYKLGIGAQGFLFKGDETYKEDVKKDKKTGLSQIVVTDKIKDVLDKIVDGGIRRRILERLNRGFEEGTDYRANVAKALANLKNLDDDPIYSDDAKTRPIRTVRKYVSSSTMVAVRKNDDGKPISFVEPDGNHHVAFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 1348 - protein, 1159 aa, unidentified
  REGION 1..1159: note = Description of Unknown: uncultivated organism with predicted taxonomy: Bacteroidales
  REGION 1..1159: note = MG16-270 effector
MKKKVLGLDLGVGSIGWALIETTDNQPEEIVGMGCRIVPIGKDDSDQFSKGQAISKNADRTARRTARKGYDRYQLRRALLTQVLRQNGMLPERMDENVIDLWKLRSDAATEGEKLTLPQIGRVLYHINQKRGYKHAKADDSADKKQTDYVAAVNQRYADLQAENKTIGQHFYLELLRSKVEGASGPYYTFRIKDKVFPRAAYIEEFDQIMHVQRTYYPTILTDELIDTLRNRIIFYQRPLKSCKHLVSLCEFEMRPYKTKDGRIVYGGPKCAPRTSPLAQLCAMWETVNNITLTNRDNEKLDITLEQRKQMVEFLCANKELKLTNLYKILGISKKDGWYGGKAIGKGLKGNATLLQLREALGGKYDQWLEMPVELKDSKWVDTETGEVIKEVTEKIEQTPLFRLWHAVYSLQNADELAKTLREKFQITDKAVIDALCKIDFVKPGYANKSHKFIRRLLPYLMNGYQFSEACARIGINHSNSMTAEERDSRTLVEQIELLPKNALRQPVIEKILNQMINLVNRLQQEYGPIDEARIELARELKQSREERDNAYKAINKNERENAAIAAKIAEFGIRPSRSRIQKYKMWEESNHRCFYCGKTMDIAQFLNGADVEIEHIIPRSILFDDSYSNKVCACRDCNREKGNSTAMEYMEGKPTGEFEAYKQRVDEAFTEHRISKTKRDHLLWRRADIPQDFIERQLRQSQYIAVKAVEILQTGIRRVWTSGGSVTDFLRHQWGYDEILHTLNLPRYRKVDELTEIVHFEHAGQEHEEERIKNWTKRIDHRHHAIDALTVALTQQSYIQRLNTLEASHEWMEKQVKEANTAYNEKKSVLERWVADQPHFSVADVTDKVDGILVSFRAGKRVTTPARRAIYSGGKRKIVQTGLQVPRGALTEDTIYGKREEGFVVKYPLDHPSMKVENILDPTIRNLVKEHIVAFGGNAKEAFKMPLYSAKGMQIKSVRCKTNLSENSVVPVKVNADGQPIGYAKKGNNHHVAIYQDKKGEYQELVVSFWDAVERKHYGVPVVIINPHEVWTDLVNKDLSQDFLNKLPHDDWQFVLSMQENEMFVLGLEDDEFNDAIERHDYNLLNKHLYRVQNISNKDYSFRYHTETKVDDKYDGIENGRSTSMTLGALFRFKSISGLLSHFPHKVKIDIMGRITKA

SEQ ID NO: 1349 - protein, 1161 aa, unidentified
  REGION 1..1161: note = Description of Unknown: uncultivated organism with predicted taxonomy: Bacteroidales
  REGION 1..1161: note = MG16-271 effector
MTKKILGLDLGVGSIGWALIETQDDKPSQILGIGSRIVPISNDDSDQFQKGQAITKNAERTQRRTARKGYDRYQLRRALLTNLLREKNMLPDYMNESAIDLWRLRSDAATEGKKLSLKEIGRVLYHINQKRGYKHSKADVSADSKQTKYVQEVNKRFQELKELGQTIGQHFYQMLQQSVVQSEKGVYYTYRIKDKVYPRRAYEEEFDKIMSTQKVFYPDILTDEFIDTLRNRIIFYQRPLKSCKHLVGLCEFEMRPYKKADGSIVYSGPKCAPRTSPLAQICAVWEAVNNIKLTNRNNEIYPISQEERQAMVDFLQTHKEMKVADMQRILGIKKSDGWWGGKAIGKGIKGNQTLCQLREALGEKYQELLKMEIKKIDSGFFDAETAEVIEIIDPACENEPLFQLWHVVYSVQDKDELRKALLKKFNIDDEQVVENLYNLDFVKPGYANKSHKFIRRILPYLMQGEMYSVACARVGINHSNSRTKEELNTRPLVEHIKLLQKNTLRQPVIEKILNQMINIVNALRDKYGEIAEVRVELARELKQNKEERETTYKNNSKNERLNREITERIKEMGIRPSRMRVQKYKLWEESLHQCFYCGKTVGAAEFLSGADVEIEHIIPRSVLFDDSYSNKVCACRECNHAKNNQTAFDFMKAQSTDKFEAYKSRVDDAFKEKRISKTKRDHLLWGLEDIPQDFIDRQLRQSQYIAAKAVEILQTAIRDVHATSGSVTELLRHQWGYDEILHHLNLPRYNKADLTEIVQYDHAGQKHTVERIKNWNKRLDQRHHAVDALTIALTKQSYIQRLNTLNASRETIYNEVEQADAKLRNEEKRTLLENWVAIQPHFPVKDVEDKVAGILVSFRAGKRVTTPAKRAVYRNGKRINVQKGLLVPRGALTEETVYGKLGDRFVVKYPHQHPSMSPDNIVDPTIRELVKKRLSEFNNDPKQAFATPLYSDKAQKMEIKSVRCFAPGVSAQGSTPVRFNNDGNPIGYSKTGNNHHIAIYKDANGKYKESVVSFTEAVHRKLIGLPIVIDNPKQVWDKVINMNLPEDYLLTLPQDNWEFVVSMQVNDMFIMGLTDVEFEDAIHEKDYALLNQHLYRVQKLSSTKYYFRYHLETSVDDKYDGVANEKLSMEIGKLINLRSPNAMAVNVHKVRISILGEITPL

SEQ ID NO: 1350 - protein, 763 aa, unidentified
  REGION 1..763: note = Description of Unknown: uncultivated organism with predicted taxonomy: Bacteroides sp. CAG:770
  REGION 1..763: note = MG16-272 effector
EAYTIKKDGKEITIGPKVAPRTSPLAQLSSIFETANNITIRNRRNDELYISPEQRRAIADFLDNHEVMKLTDLYKILNIGRKDGWWAGKAIGKGLKGNTTKCQIREALSILPKEQVDSLTAFQLEFDEYVDEETGEVRKRINNARAEQQPLYKLWHLLYSIKDNDELSGALRHLGIEDEESIEKLCKLDFRTAGYANKSSKAIGRILPYLMEGVMYSEACERAGFDHSRRINPDRILLTHLPQIQKNELRQPVVEKILNQLVNIVNALLEKEGAIDEIRVELARELKQSKDERNEAFKRNNQNERQNKDYAERIKEYGLTPTRNRIMKMRMWEESEYTCMYCGQPVNVTEFLKGADVEREHIIPRGLLFDNSFTNQVCSCRRCNSKKGMRTAYDFIADEKGQEGLDTYIDRINDLFNRKKISRSKLNRLFVSYKAYMSRKAQGKETDEDKDLWENFIDRQLRQSQYIAKKSVEMLQQVCKNVYTTSGSVTDFVRHQWGYDELLHELNFERFKKAGLTAMVKQLHSGKEIEVERIKDWTKRLDNRHHAVDALAIACTTQGMIQRLNTLNASRDEMQEELSSKEQRLVDPERSMLEKWIFAQPHISYAEAKNEIDKIIISQRPNTRITVPGKRYVTKNGKRTLAQTGIIVPRGALHAEFVYGRIMKQEADGVTMIPQYVRKYKLGIGAQGFLFNGKEFYKEELKKDSKTGLSSIVVTDKIKDVLEKIVDGGIRQRILERLNRGFEEGTDYRSNVAQALDNLKNLD

SEQ ID NO: 1351 - protein, 1016 aa, unidentified
  REGION 1..1016: note = Description of Unknown: uncultivated organism with predicted taxonomy: Bacteroidetes
  REGION 1..1016: note = MG16-273 effector
VLLHINQKRGYKHSRLSNSDSKETAYVQEVNSRYDDLMAEGLTIGQHFAAKLKENEQESIDGKKYYNYRIKEQVYPRHAYEEEAKKILEVQSRYHSDVLTPDVCKEMMGIIFYQRDLKSCKNLVSLCEFESYTITKDGKEITIGPKVAPRTSPLAQLSSILETANNITIRNKRNDELYISPEQRKAIADFLDNHEVMKLTDLYKILNIGRKDGWWAGKAIGKGLKGNTTKCLIREALSALPKEQVDTLTSFQLEFDEYVDEETGEIRKRINNTLAEQQPLYKLWHMLYSIKDNTELSGALHHLGIEDKESLEKLCRLDFRTAGYASKSAKAIGRILPYLMEGVMYSEACERAGLDHSRRIDPNRTLLTHLPQIQKNELRQPVVEKILNQLVNVVNALLEKEGAIDEIRIELARELKQSKDERNETFKRNNQNERQNKEYAERIKKYGLTPTRNRIMKLKMWEESEHACMYCEQPVDPIEFLKGADVEREHIIPRGLLFDNSFTNQVCSCRRCNSKKGMRTAYDFIADDKGQEGLNAYIEHINDLFDKKKISRSKLNRLLVSHKAYISRKAQGKETEEDKELWENFIDRQLRLSQYIAKKSVEMLQQVCKNVYATSGSITDFVRHQWGYDELLHDLNFERFKKAGLTTMVKQLHSGEEVEVERIANWTKRLDNRHHAVDALAIACTTQSMIQRLNTLNASRDDMLEEQNSKDQRLVDPERSMLEKWVFIQPHITYADAKKEIDKIVISQRPNTRITVPGKRYITKNGKRTLVQTGIIVPRGALHAEFVYGRIMKRDIDGVTMTPQYVRKYKLGIGAQGFLFNGKEFYKEELKKDSKTGLSKIVVTDKIKDVLEKIVDGGIRQRILERLNRGFEEGADYRANVAQALANLKNLDEDPVYSDDAKTRPIRTVRKYVSSSTMVAVRKDDKGKPVAFVEPDGNHHVAFYKDDNGVITETIVTKWQAVQRKLYHIPIIIDNPSQTWSEVLERNDVPDELLQSLPKDSSTFLLSLQIGEAFIM

SEQ ID NO: 1352 - protein, 951 aa, unidentified
  REGION 1..951: note = Description of Unknown: uncultivated organism with predicted taxonomy: Bacteroidales
  REGION 1..951: note = MG16-274 effector
LFITREQKQQIANIMDNKEVLKLKDVHEVLGINSKSGWYCDKAIKSGIKGNSTKCAIISALSSLPNSTIREITRFNLETETTNMVDEETGELLVRIKSTYQEEPLYRLWHIIYSIKNDAERLNTILVFLKEFGIEDVSIANALNDIDFVTPGYANLSAKAISKILPYMMEGLDYSESCEYVGYNHSDSLTKEENEKRELLDQIPAIKKNELRQPTVEKILNQTINVFNQINAELGKKGERVDEVRVELARELKQSKEEREETDKGIRKQQKANEEYADILKKKGVRPTRNRILKYRLWKESEEACFYCGRDIDFHEFLRFSDIEREHVIPKKLLFDDSFANQVCSCRRCNAEKGGRTALDYMRTKPNLQEYLDKVDKMFQEHKIGGKKHTHLLASYDDYLSRKKEGKETKDDILIWEEPIDRQLRLSQYISKKAQELLKTACREVMATSGSITDLIRHTWGYDTILHELNFPRYKDAGLTEIIKDEETGMQRELIPDWSKRLDHRHHAIDALAVACTSRSIVQRINTLHASREIIRDEIKTSRKEWEDNDLLQQWIKEKMPFDRQYVVQKVASILVSMKAGKKATVPGKRKIYKNGKPVIMQTGLRIPRGQLHEQTVYGAIKHHSKDKKGNVIETKEIVTRYKMGVGSVGFVFTGKETCDVVFDKKNERYVIVDGIGKAINYIVDRHIREIVRERINEAFPDGETYLSEAEKALAEGKPYNGKGRSQKALEQLKALDEHPLYADKNKTIVIKSVRCFTGLNAVQPLRYNSKHEPISFVLTKNNHHVAIYVDEKGEYQECVYTFWQVVERAKYRLPLIIQDPKTIWDEIRQREKDGDSFPDDLITSLPLPNWTFVESLQQNDMFVMDMDDDTFKENVTSNNYKELGEKLYRVQNLSTHDYFFRLHSDTTSKTTPDLAQCKKFIRIKSFKAYFEHNPHKVQLSLLGKIILKND

SEQ ID NO: 1353 - protein, 984 aa, unidentified
  REGION 1..984: note = Description of Unknown: uncultivated organism with predicted taxonomy: Bacteroidetes
  REGION 1..984: note = MG16-275 effector
YENKEGKIVFGGPKVAPKSSPLFQICKIWEAVNNITLKNRKNDELYITLEQRKAMVDFLDTHEKLTLKEVYSILGISKQDGWWGGKAIGRGLQGNTTKIALKNALGDFDNAEKLLQFNLKNTDSGLIDEVTGEVIQMIDAKVEKEPLYDLWHTVYSISDKAELANALKKKFNIYDEDIINSLYAIDFVKQGFGNKSAKAMRRILPYLQQGMKYSDACEYEGFSHSDSLTKTENEARQLLEKLPPIQKNALRQPIVEKILNQMINVVNALMVEYGQFESIRVELARELKQSKDDRNTTFLQNEAMEKLNEAIAKRLTSEGITPTKRIMEKYKFIFPTKGCIDKKTGKFVTKNFDALATVNQCIYCGKPFSLSAALNGEGYEIEHIIPRDMICDNSQSNKVLSCRSCNSKKSNKTAFDFMRSQDKAMFDDYIKRVEKWFDDGIISPSKRERLLLSHEDYMERKKKGKTTEEDKKYWEEFVSRQAGETQYISRESIRILKQCCRNVNATSGTVTATLRHLWGYDEILHQLNFERYKQAGLTETVTWTSNHGKNEHSKEQIVDWSKRIDHRHHAIDALVVACTQQGFIQRINTLNADDTKDLMRKQIESAGIKFEEKKVLLDKYLASFVPFTTKVVADEVNKILVSFKAGKKSASTGKRIKYVKGKKEVLQEGVIIPRGALHEEGVYGQIEINGEKVIVKKYKLGKGAQGFVFTGKETYEEKVNKKTGEVQVDDKIKNVLDSIVDGNIRAKVLQRLNQGFEEGKDYRNDVKKALDNLNNLDKNPIFADENKTIPIRTVRCRTGLSAVVPVKCNEQGEPIGFVKPGNNHHIAIYRDKEGQLQEHTVTFWHAVERKKYGLPVIIENPTEVWDSIMDRQLPESFLEKLPVVNWTFEMSLQQNEMFVLGMEDETFENAIREKNYSMIGAYLYRVQSISESDYWFRLHIETQNDKTPSAKLAMKYHRVKSLKAFYGLNPHKVYVSVIGKMKEL

SEQ ID NO: 1354 - protein, 1348 aa, unidentified
  REGION 1..1348: note = Description of Unknown: uncultivated organism with predicted taxonomy: Clostridiales
  REGION 1..1348: note = MG18-1 effector
MDQSKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWAVFARLLPEGKTISEVKTEEYEAYKADLRALKQLVKQYASDQYYRVFRSAKIKGNYASYVGKTNCGNEKSNPESCKPEEFFAFLKKELKPLWSQNIPAAASLAAKLESGTLLRRQRSGENAAIPYQAHLQELQIILKNMQQFYPFLQKADENGFTPAYKIEKLLTFRIPYYVGPLNDAHKEKGFCWIVKKADVPVLPWNFDQVVDENACEDAFIGRMSATCTYLVGENVLPQNSPLYCRFMVLNELNNLRIRSEKITPALKQAIFTQLFCAGKGGKVTQKKLLDFLHSQGIDANKQDISGIDGDFKASMAPAVKLQSIFTEPLPPEILERLAFALTVSGESHKMLQNRIRAILPNADNAVIRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 1355 - protein, 1379 aa, unidentified
  REGION 1..1379: note = Description of Unknown: uncultivated organism with predicted taxonomy: Phascolarctobacterium succinatutens
  REGION 1..1379: note = MG18-3 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRHQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQKVDLMKL

SEQ ID NO: 1356 - protein, 1379 aa, unidentified
  REGION 1..1379: note = Description of Unknown: uncultivated organism with predicted taxonomy: Phascolarctobacterium succinatutens
  REGION 1..1379: note = MG18-4 effector
MQKLKNCDYYIGLDMGDASVGWAVTDTNYNILKFNGKALWGIRLFDSANTAASTRVFRSGRRRIDRTTWRLKMLQELFADEIAKVETGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVATILKTAYKHSEIVYVKAGNVSDFRQKFEFVKCRDVNDLHHAKDAYLNIVVGNCYHVKFTDKPMDFIKKNQDNRSYSLKPEIFYKFSIKRDSEIAWVGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1357 - protein, 1379 aa, unidentified
  REGION 1..1379: note = Description of Unknown: uncultivated organism with predicted taxonomy: Phascolarctobacterium succinatutens
  REGION 1..1379: note = MG18-5 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1358 - protein, 1379 aa, unidentified
  REGION 1..1379: note = Description of Unknown: uncultivated organism with predicted taxonomy: Phascolarctobacterium
  REGION 1..1379: note = MG18-6 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGEDGTMAIVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRHGKQLIFYVAGQLCLDEESIAYLKKAFKYESDLAINEEIIDDKNAAEENKQKAHEKLGFYENTWGISEASNMRLYDILIAKSANNFYKNRPASQTSVLKQQRDKFAKLPLSKQIRVINEAINLFKCASATADFKLLEKGSACGKIQVSTNITKCKQCILINQSPTGVFEQEVDLMKL

SEQ ID NO: 1359 - protein, 1383 aa, unidentified
  REGION 1..1383: note = Description of Unknown: uncultivated organism with predicted taxonomy: Acidaminococcales
  REGION 1..1383: note = MG18-7 effector
MQNKKNVDYYVGLDMGDASVGWAVTDLNYNILKFNGKALWGIRLFDSAETAAARRGFRSARRRIDRVSWRISMLQELFAEEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLEFYKNTWEISAVANLQIYDMLLAKSANNLYKNRPASQTATLKEKREQFAKLSLSKQIHVIKEILNLFKCASASADFKLLDKGTSCGTLKVSNNITKLKQCVLINQSPTGVFEQEVDLMKL

SEQ ID NO: 1360 - protein, 1379 aa, unidentified
  REGION 1..1379: note = Description of Unknown: uncultivated organism
  REGION 1..1379: note = MG18-8 effector
MQKSKNCDYYIGLDMGDASVGWAVTDTNYNISKFNGKALWGIRLFDYANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTVEEHLLFRITNGFAFPKQTTKDNGIIPIQVHLAELKCILDNAEGYLPFLGETNNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCKEENIDFVPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQAVEGKGELFKQNPLKANSGQLPLKAGLSIEKYGGYNSLTTAYFAVVKSEGKKGAVQLSIEAIPLVYAKQGEIAVQNYLTEVVQLCKPEIMLSKIKKYSLFKINGFPMHISGRTDNRILFYGAGQLCIDEADADYLKKALKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQEVDLMKL

SEQ ID NO: 1361 - protein, 1379 aa, unidentified
  REGION 1..1379: note = Description of Unknown: uncultivated organism with predicted taxonomy: Phascolarctobacterium succinatutens
  REGION 1..1379: note = MG18-9 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1362 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-10 effector

SEQ ID NO: 1363 - protein, 1379 aa, unidentified
  REGION 1..1379: note = Description of Unknown: uncultivated organism with predicted taxonomy: Phascolarctobacterium succinatutens
  REGION 1..1379: note = MG18-11 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1364 - protein, 1379 aa, unidentified
  REGION 1..1379: note = Description of Unknown: uncultivated organism with predicted taxonomy: Phascolarctobacterium succinatutens
  REGION 1..1379: note = MG18-12 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1365 - protein, 1379 aa, unidentified; identical to SEQ ID NO: 1356
  REGION 1..1379: note = Description of Unknown: uncultivated organism with predicted taxonomy: Phascolarctobacterium succinatutens
  REGION 1..1379: note = MG18-13 effector

SEQ ID NO: 1366 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-14 effector

SEQ ID NO: 1367 - protein, 1379 aa, unidentified
  REGION 1..1379: note = Description of Unknown: uncultivated organism with predicted taxonomy: Phascolarctobacterium succinatutens
  REGION 1..1379: note = MG18-15 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFEKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1368 - protein, 1379 aa, unidentified; identical to SEQ ID NO: 1364
  REGION 1..1379: note = Description of Unknown: uncultivated organism with predicted taxonomy: Phascolarctobacterium succinatutens
  REGION 1..1379: note = MG18-16 effector

SEQ ID NO: 1369 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-17 effector

SEQ ID NO: 1370 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-18 effector

SEQ ID NO: 1371 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-19 effector

SEQ ID NO: 1372 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-20 effector

SEQ ID NO: 1373 - protein, 1379 aa, unidentified; identical to SEQ ID NO: 1361
  REGION 1..1379: note = Description of Unknown: uncultivated organism with predicted taxonomy: Phascolarctobacterium
  REGION 1..1379: note = MG18-21 effector

SEQ ID NO: 1374 - protein, 1379 aa, unidentified; identical to SEQ ID NO: 1356
  REGION 1..1379: note = Description of Unknown: uncultivated organism with predicted taxonomy: Phascolarctobacterium
  REGION 1..1379: note = MG18-22 effector

SEQ ID NO: 1375 - protein, 1379 aa, unidentified
  REGION 1..1379: note = Description of Unknown: uncultivated organism with predicted taxonomy: Phascolarctobacterium succinatutens
  REGION 1..1379: note = MG18-23 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKKSVSFQDDDLNEFEPVLTAALGERYEGLLRFKAIYDWSLLAKILHLDTSKKDEGEQHLLSECKVQVYENHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVVRTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1376 - protein, 1379 aa, unidentified
  REGION 1..1379: note = Description of Unknown: uncultivated organism with predicted taxonomy: Phascolarctobacterium
  REGION 1..1379: note = MG18-24 effector
MQKLKNCDYYIGLDMGDASVGWAVTDTNYNILKFNGKALWGIRLFDSANTAASTRVFRSGRRRIDRTTWRLKMLQELFAEEIAKVDSGFFMRLEDSRLQLDDKREKAVYNLFVDKNYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWSLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGNRLVFYGAGQLCISENETVYLKRALKYRDSIEENENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1377 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-25 effector

SEQ ID NO: 1378 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-26 effector

SEQ ID NO: 1379 - protein, 1379 aa, unidentified
  REGION 1..1379: note = Description of Unknown: uncultivated organism with predicted taxonomy: Phascolarctobacterium succinatutens
  REGION 1..1379: note = MG18-27 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSLEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1380 - protein, 1379 aa, unidentified
  REGION 1..1379: note = Description of Unknown: uncultivated organism with predicted taxonomy: Phascolarctobacterium
  REGION 1..1379: note = MG18-28 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVVTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSNIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1381 - protein, 1379 aa, unidentified
  REGION 1..1379: note = Description of Unknown: uncultivated organism with predicted taxonomy: Phascolarctobacterium succinatutens
  REGION 1..1379: note = MG18-29 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1382 - protein, 1148 aa, unidentified
  REGION 1..1148: note = Description of Unknown: uncultivated organism with predicted taxonomy: Phascolarctobacterium succinatutens
  REGION 1..1148: note = MG18-30 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKVVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKMEQFSYL

SEQ ID NO: 1383 - protein, 1148 aa, unidentified; identical to SEQ ID NO: 1382
  REGION 1..1148: note = Description of Unknown: uncultivated organism with predicted taxonomy: Phascolarctobacterium succinatutens
  REGION 1..1148: note = MG18-31 effector

SEQ ID NO: 1384 - protein, 1379 aa, unidentified
  REGION 1..1379: note = Description of Unknown: uncultivated organism with predicted taxonomy: Phascolarctobacterium succinatutens
  REGION 1..1379: note = MG18-32 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVYDFNAVFSEVENYVRDEMGIEDWSCQNIDELAKVLYDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPRKDEFNTLKTQLSSKKEDDLRIDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGTSCGVIKTSNNITKCEQCILINQSPTGVFEQEVDLMKL

SEQ ID NO: 1385 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-33 effector

SEQ ID NO: 1386 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-34 effector

SEQ ID NO: 1387 - protein, 1379 aa, unidentified; identical to SEQ ID NO: 1364
  REGION 1..1379: note = Description of Unknown: uncultivated organism with predicted taxonomy: Phascolarctobacterium succinatutens
  REGION 1..1379: note = MG18-35 effector

SEQ ID NO: 1388 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-36 effector

SEQ ID NO: 1389 - protein, 1379 aa, unidentified
  REGION 1..1379: note = Description of Unknown: uncultivated organism with predicted taxonomy: Phascolarctobacterium succinatutens
  REGION 1..1379: note = MG18-37 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIGFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKEKAQKGLDFYEQKWGISGAVNVQLYDMFIAKSANNLYKNRPVSQTITLKEKREHFVKLTVSKQIHIIKEILNLFKCASASDDFKLIDKGTSCGTLKISNNINKLKECILINQSPTGVFEQEVDLMKL

SEQ ID NO: 1390 - protein, 1379 aa, unidentified
  REGION 1..1379: note = Description of Unknown: uncultivated organism with predicted taxonomy: Phascolarctobacterium
  REGION 1..1379: note = MG18-38 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1391 - protein, 1379 aa, unidentified
  REGION 1..1379: note = Description of Unknown: uncultivated organism with predicted taxonomy: Phascolarctobacterium
  REGION 1..1379: note = MG18-39 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1392 - protein, 1379 aa, unidentified
  REGION 1..1379: note = Description of Unknown: uncultivated organism with predicted taxonomy: Phascolarctobacterium succinatutens
  REGION 1..1379: note = MG18-40 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVVSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1393 - protein, 1291 aa, unidentified
  REGION 1..1291: note = Description of Unknown: uncultivated organism with predicted taxonomy: Phascolarctobacterium succinatutens
  REGION 1..1291: note = MG18-41 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLSFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKIQLNSKKDYDLRSDKLYLYYTQMGRCMYTGERIELASLYDDNLYDIDHIYPRSKTKDDSLSNRVLVKKEVNAAKTDIYPLDAAIRTKMHSFWKLLYDKGLIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTAHPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKI

SEQ ID NO: 1394 - protein, 1379 aa, unidentified; identical to SEQ ID NO: 1355
  REGION 1..1379: note = Description of Unknown: uncultivated organism with predicted taxonomy: Phascolarctobacterium succinatutens
  REGION 1..1379: note = MG18-42 effector

SEQ ID NO: 1395 - protein, 1379 aa, unidentified; identical to SEQ ID NO: 1364
  REGION 1..1379: note = Description of Unknown: uncultivated organism with predicted taxonomy: Phascolarctobacterium succinatutens
  REGION 1..1379: note = MG18-43 effector

SEQ ID NO: 1396 - protein, 1379 aa, unidentified
  REGION 1..1379: note = Description of Unknown: uncultivated organism with predicted taxonomy: Phascolarctobacterium succinatutens
  REGION 1..1379: note = MG18-44 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDEFAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAALKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERLFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSVWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSMQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1397 - protein, 1379 aa, unidentified
  REGION 1..1379: note = Description of Unknown: uncultivated organism with predicted taxonomy: Phascolarctobacterium succinatutens
  REGION 1..1379: note = MG18-45 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1398 - protein, 1158 aa, unidentified
  REGION 1..1158: note = Description of Unknown: uncultivated organism with predicted taxonomy: Phascolarctobacterium
  REGION 1..1158: note = MG18-46 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFKRIFGEDYIQLHREEIENIIRWITLFCDEKKMLVTKIKNTYTQISDDEIKAIKKLKYKDWGRLSATLLNSRAIGYEDKAVGEIITIISALRHTNKNLMELLSNYCPYDFIGEIKDFNGSRQSSNGKLTYKDVEELYVSPSVKRSIWQTLTILEEIKKIMGCESKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANHLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAK

SEQ ID NO: 1399 - protein, 1383 aa, unidentified; identical to SEQ ID NO: 1359
  REGION 1..1383: note = Description of Unknown: uncultivated organism with predicted taxonomy: Phascolarctobacterium
  REGION 1..1383: note = MG18-47 effector

SEQ ID NO: 1400 - protein, 1379 aa, unidentified
  REGION 1..1379: note = Description of Unknown: uncultivated organism with predicted taxonomy: Phascolarctobacterium succinatutens
  REGION 1..1379: note = MG18-48 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLDDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1401 - protein, 1379 aa, unidentified
  REGION 1..1379: note = Description of Unknown: uncultivated organism with predicted taxonomy: Phascolarctobacterium succinatutens
  REGION 1..1379: note = MG18-49 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEHREFFEKLSLANQIHVIGEVLKLFKCASASANLKLLDKGNACGVIKVSNNILKFKQCVLINQSPTGVFEQEVDLMKL

SEQ ID NO: 1402 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-50 effector

SEQ ID NO: 1403 - protein, 1275 aa, unidentified
  REGION 1..1275: note = Description of Unknown: uncultivated organism with predicted taxonomy: Phascolarctobacterium succinatutens
  REGION 1..1275: note = MG18-51 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIILPKIKKYSLFKINGFPMHISGRQLKQLQFYVASQLCIDEYSIAYLKKAFKYENNLAVNDEIIADKNADEEKKQKARKRLDFYEKTWGIGKENNMR

SEQ ID NO: 1404 - protein, 1379 aa, unidentified
  REGION 1..1379: note = Description of Unknown: uncultivated organism with predicted taxonomy: Phascolarctobacterium succinatutens
  REGION 1..1379: note = MG18-52 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1405 - protein, 1379 aa, unidentified
  REGION 1..1379: note = Description of Unknown: uncultivated organism with predicted taxonomy: Firmicutes
  REGION 1..1379: note = MG18-53 effector
MQKLQNKDYYIGLDMGDASVGWAVTDANYNILKVNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKVFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRNTQLGDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLLKINGFPMHISGKTVKQIIFYAAGQLCLADDVADYLKKALKYEVYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1406 - protein, 1379 aa, unidentified
  REGION 1..1379: note = Description of Unknown: uncultivated organism with predicted taxonomy: Phascolarctobacterium
  REGION 1..1379: note = MG18-54 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKNYTDKEFYQQYPTMYHLRYALATQKGHFDVRLLYLAVQHIAKHRGHFLFDNLDASKVNDFNAVFSEVENYVRDEMGIEDWSCQNVDELAKVLCDVNLGRTIKQKAMQSLLPAQTKQQKAIIQLFSGGKAKLAELFLDEELDECEKKSVSFQDDDLDELEPVLTAALGERYEGLLRFKAIYDWNLLAKILHLDAEKKDDSEQHLLSECKVQVYEEHKRDLTVLKSMLKGKPLYNKIFRQDGDISYEKYAKGIKGRNQIDFCKDLKKQLEGIAEYKKIMQEITSIDDAKTEEERLLFRIANGFAFPKQTTKDNGIIPIQVHLAELKCILDNAESYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDNKINASMKSYNDFRRIFGEDYIQLHRDEIENIIRWITLFCDEKKMLATKIRNTYPQISDDKIKAIKKLKYKDWGRLSATLLNSSAIAYEDKGFGELVTIISALRHTNKNFMELLSSYCSYDFIGKIKEYNSGRQNSNSKLTYKDVEELYVSPSVKRSIWQTLTILEEIKKITGHEPKRIFIEMARSKEESKRTDSRLKKLQDLYKQCKEENIDFMPHTDELNAFKIQLSSKKEDDLRSDKLYLYYTQMGRCMYTGERIEIASLYDDNLYDIDHIYPRSKTKDDSLSNRVLVKKEVNAAKTDIYPLDAAIRTKMHTFWKLLYDKGFIDERKYERLIRSKQLRDEELAGFISRQLVETRQSTKAVATILKTAYKHSEIVYVKAGNVSDFRQKFEFVKCRDVNDLHHAKNAYLNIVVGNCYYVKFTAKPLDFIKKNQDNRSYSLKPEIFYKFSIKRDSEIAWVGGKDGTITTVTKTIHKNNILFTRQPVEGKGELFKQNPLKANSGQLPLKAGLSVEKYGGYDSLTTAYFALVKSEGKKGAVQLSIEAIPLVYAKQGENAVQKYLTDVVQLCKPEIKIPKIKKYSLFKINGFPMHIYGRTGNRLVFYGAGQLCISENETVYLKRALKYRDSIEKNENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 1407 - protein, 1379 aa, unidentified
  REGION 1..1379: note = Description of Unknown: uncultivated organism with predicted taxonomy: Phascolarctobacterium
  REGION 1..1379: note = MG18-55 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKMMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISSVKQCILINQSPTGIFEQEVDLMKL

SEQ ID NO: 1408 - protein, 1379 aa, unidentified
  REGION 1..1379: note = Description of Unknown: uncultivated organism with predicted taxonomy: Phascolarctobacterium succinatutens
  REGION 1..1379: note = MG18-56 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1409 - protein, 1379 aa, unidentified
  REGION 1..1379: note = Description of Unknown: uncultivated organism with predicted taxonomy: Phascolarctobacterium succinatutens
  REGION 1..1379: note = MG18-57 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQTGPIDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEEHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEDSAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKDVEELYVSPSVKRSIWQTLTILEEIKKIMGCEPKRIFIEMARSKEESKRTDSRLKKLHDLYKKCREENIDFMPRKDEFNALKTQLSSKKEENLRSDKLYLYYTQMGRCMYTGERIELASLHDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1410 - protein, 1379 aa, unidentified
  REGION 1..1379: note = Description of Unknown: uncultivated organism with predicted taxonomy: Phascolarctobacterium succinatutens
  REGION 1..1379: note = MG18-58 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFFFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCHHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1411 - protein, 1379 aa, unidentified; identical to SEQ ID NO: 1405
  REGION 1..1379: note = Description of Unknown: uncultivated organism with predicted taxonomy: Phascolarctobacterium succinatutens
  REGION 1..1379: note = MG18-59 effector

SEQ ID NO: 1412 - protein, 1345 aa, unidentified
  REGION 1..1345: note = Description of Unknown: uncultivated organism
  REGION 1..1345: note = MG18-60 effector
NGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1413 - protein, 1259 aa, unidentified
  REGION 1..1259: note = Description of Unknown: uncultivated organism with predicted taxonomy: Phascolarctobacterium succinatutens
  REGION 1..1259: note = MG18-61 effector
MLQELFAEEIAKVDPGFFMPLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEKIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRELNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASA

SEQ ID NO: 1414 - protein, 1379 aa, unidentified
  REGION 1..1379: note = Description of Unknown: uncultivated organism with predicted taxonomy: Phascolarctobacterium succinatutens
  REGION 1..1379: note = MG18-62 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGTQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1415 - protein, 1379 aa, unidentified
  REGION 1..1379: note = Description of Unknown: uncultivated organism
  REGION 1..1379: note = MG18-63 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1416 - protein, 1379 aa, unidentified
  REGION 1..1379: note = Description of Unknown: uncultivated organism with predicted taxonomy: Phascolarctobacterium succinatutens
  REGION 1..1379: note = MG18-64 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAVYNLFVDKSYTDKEFYQQYPTMYHLRYALATQKGPFDVRLFYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLDEIEPVLTAALGERYEGLLRFKAIYDWSLLAKILHLDAEKKDDSEQHLLSECKVQVYEEHKRDLAVLKSMLKGKPLYNKIFRQDGDISYEKYAKGIKGCNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQYLYKKCREENIDFMPRKDEFNALKTQLSSKKEEDLRSDKLYLYYTQMGRCMYTGESIELASLYDNNLYDIDHIYPRSKTKDDSLSNRVLVQKQVNAAKTDIYPLDAAIRTKMHSFWNLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1417 - protein, 1379 aa, unidentified
  REGION 1..1379: note = Description of Unknown: uncultivated organism with predicted taxonomy: Firmicutes
  REGION 1..1379: note = MG18-65 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQPLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1418 - protein, 1379 aa, unidentified
  REGION 1..1379: note = Description of Unknown: uncultivated organism with predicted taxonomy: Phascolarctobacterium succinatutens
  REGION 1..1379: note = MG18-66 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLQLDDKREKAVYNLFVDKSYTDKEFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLCNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYSQISDDEIKAIKKLKYKDWGRLSATLLNSSTIAYEDKAFGELVTIISALRHTNKNFMELLSSYCYYDFIGKIKEFNGSRQSSNGKPTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1419 - protein, 1379 aa, unidentified
  REGION 1..1379: note = Description of Unknown: uncultivated organism
  REGION 1..1379: note = MG18-67 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKNLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTFLEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKIAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1420 - protein, 1379 aa, unidentified
  REGION 1..1379: note = Description of Unknown: uncultivated organism with predicted taxonomy: Phascolarctobacterium succinatutens
  REGION 1..1379: note = MG18-68 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYTKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1421 - protein, 1379 aa, unidentified
  REGION 1..1379: note = Description of Unknown: uncultivated organism with predicted taxonomy: Phascolarctobacterium succinatutens
  REGION 1..1379: note = MG18-69 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVSIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1422 - protein, 1379 aa, unidentified; identical to SEQ ID NO: 1360
  REGION 1..1379: note = Description of Unknown: uncultivated organism with predicted taxonomy: Negativicutes
  REGION 1..1379: note = MG18-70 effector

SEQ ID NO: 1423 - protein, 1379 aa, unidentified
  REGION 1..1379: note = Description of Unknown: uncultivated organism with predicted taxonomy: Phascolarctobacterium succinatutens
  REGION 1..1379: note = MG18-71 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1424 - protein, 1379 aa, unidentified
  REGION 1..1379: note = Description of Unknown: uncultivated organism with predicted taxonomy: Phascolarctobacterium succinatutens
  REGION 1..1379: note = MG18-72 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1425 - protein, 1379 aa, unidentified
  REGION 1..1379: note = Description of Unknown: uncultivated organism with predicted taxonomy: Phascolarctobacterium
  REGION 1..1379: note = MG18-73 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1426 - protein, 1379 aa, unidentified
  REGION 1..1379: note = Description of Unknown: uncultivated organism with predicted taxonomy: Phascolarctobacterium succinatutens
  REGION 1..1379: note = MG18-74 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1427 - protein, 1379 aa, unidentified; identical to SEQ ID NO: 1358
  REGION 1..1379: note = Description of Unknown: uncultivated organism with predicted taxonomy: Phascolarctobacterium
  REGION 1..1379: note = MG18-75 effector

SEQ ID NO: 1428 - protein, 1124 aa, unidentified
  REGION 1..1124: note = Description of Unknown: uncultivated organism with predicted taxonomy: Phascolarctobacterium succinatutens
  REGION 1..1124: note = MG18-76 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRKQFKFVKCRDVNDLHHAKDAYLNIVVGNCYHVKFTANPLNFITKNQDNRRYSLKPEIFYKFSIKRDGEIAWIGGKDGTITTVTKTMHKNNILFTRQPVEGKGELFKQQPLKAKSGQLPLKAGLSVEKYGG

SEQ ID NO: 1429 - protein, 811 aa, unidentified
  REGION 1..811: note = Description of Unknown: uncultivated organism with predicted taxonomy: Clostridiales
  REGION 1..811: note = MG18-77 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQGRKY

SEQ ID NO: 1430 - protein, 1379 aa, unidentified; identical to SEQ ID NO: 1397
  REGION 1..1379: note = Description of Unknown: uncultivated organism with predicted taxonomy: Phascolarctobacterium
  REGION 1..1379: note = MG18-78 effector

SEQ ID NO: 1431 - protein, 1379 aa, unidentified
  REGION 1..1379: note = Description of Unknown: uncultivated organism with predicted taxonomy: Phascolarctobacterium succinatutens
  REGION 1..1379: note = MG18-79 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWKFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKRREENIDFMPRKDEFNALKTQLSSKKEENLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKRGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1432 - protein, 1379 aa, unidentified; identical to SEQ ID NO: 1375
  REGION 1..1379: note = Description of Unknown: uncultivated organism with predicted taxonomy: Phascolarctobacterium succinatutens
  REGION 1..1379: note = MG18-80 effector

SEQ ID NO: 1433 - protein, 1383 aa, unidentified
  REGION 1..1383: note = Description of Unknown: uncultivated organism with predicted taxonomy: Phascolarctobacterium succinatutens
  REGION 1..1383: note = MG18-81 effector
MQNKKNVDYYVGLDMGDASVGWAVTDLNYNILKFNGKALWGIRLFDSAETAAARRGFRSARRRIDRVSWRISMLQELFADEIAKVDAGFFQRLKDSRLQVEDKQEKTAYNLFVGQNYTDKDFYQQYPTMYHLRYALATQAGPFDVRLLYLAVQHIVKHRGHFLFENLDASKVGDFVAVFGEVESYVHDEMELDEWYCHDIDALAKVLCNANLGITAKQKAIQNLLPAKTKQEKAIVQLLSGGKAKLCDLFCDEELAECEKKSISFQEDNLDELEPILEAILQERYEALLRFKAVYDWSLLAKILRLDADKKSENEMHLLSECKVKVYEEHKKDLAVLKSMLKGKPLYNKLFRQDGEDTYANYAQGIKGINQVDFCKSLKKQLESIGEYKKQMQQLTSFEDAQTDVERLLFRVANGLAFPKQTTKDNGIIPIQVHLAELQCILAHAEKYLPFLKNADANGLSVREKITQIVKFRIPYYVGPLAGTRLSREQGRCWVERRAELKNEKIYPWNFDKVVDLEASAENFITNMTAKCTYLVGEDVLPKESLLYSEFMVRNALNNLTIDGERLPVSLLQKIYKQLFLEKTFKVTKKALERFFKQENVSYHDIGGIDDKINASMKAYNDFKRIFGEAYIEMHRDEIENIIRWITLFCDEKKMLETKIRKTYPQIPDDKIKAIKKLKYKDWGRLSATLLDSGKIAYEDASVGERITIISALRHTNKNFMELLSSNCQYDFIGKIKDFNGSKQSDNGKLTYKDVEELYVSPSVKRSIWQTLTILEEIKKIMGCEPKRIFIEMARSKEESLRTNSRLQRLQDLYKKCKEENIDFMPKADELTDIRSQLQCKNEEDLRSDKLYLYYTQMGRCMYTGERIELASLYDQNKYDVDHIYPRSKTKDDSLNNRVLVKKEINSAKTDNYPIDADIRKKMHAFWKMLYDKGFIDQKKYERLTRSTQLTDEELAGFINRQLVETRQSTKATADILKSAYEHSEVVYVKAGNVSDFRQQFDFVKCREVNDLHHAKDAYLNIVVGNCYHVKFTINPLMFIRGNQDNRRYSLKPEVFYAHDIKRNGEIAWLAGDNGTMATVKRVMQKNNVLFTRLAVEGKGELFKQNPLKAKSGQLPLKAGLSIDKYGGYDSLSTAYFALVESEGKKGAVQFTIEAIPLVYAKQGEATIKKYLTEVVQLCKPEIKVMRIKKYSLLKINGFPMHISGRTGKQLIFYVASQLCIDENSVAYLKKALKYESNLEENEAILADKNADESMKQKAFNRLMFYKDTWGISAEANLQLYDMLLAKSANNLYKNRPASQTATLKEKREQFAKLSLSKQIHVIKEILNLFKCASASADFKLLDKGAACGILKVSNNITKLKQCVLINQSPTGVFEQEVDLMRL

SEQ ID NO: 1434 - protein, 1379 aa, unidentified
  REGION 1..1379: note = Description of Unknown: uncultivated organism with predicted taxonomy: Phascolarctobacterium succinatutens
  REGION 1..1379: note = MG18-82 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELSVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQVGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1435 - protein, 1379 aa, unidentified
  REGION 1..1379: note = Description of Unknown: uncultivated organism with predicted taxonomy: Phascolarctobacterium succinatutens
  REGION 1..1379: note = MG18-83 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEKERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVFPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLIKL

SEQ ID NO: 1436 - protein, 1379 aa, unidentified
  REGION 1..1379: note = Description of Unknown: uncultivated organism with predicted taxonomy: Phascolarctobacterium succinatutens
  REGION 1..1379: note = MG18-84 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRIDKLYLYYTQMGRCMYTGERIELASLYDNNLYDIDHIYPRSKTKDDSLSNRVLVKKQVNAAKTDTYPLDAAIRIKMHSFWKLLYDKGFIDERKYERLTRSTQLRDEELAGFISRQLVETRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1437 - protein, 1379 aa, unidentified
  REGION 1..1379: note = Description of Unknown: uncultivated organism with predicted taxonomy: Phascolarctobacterium
  REGION 1..1379: note = MG18-85 effector
MQKLQNKDYYIGLDMGDASVGWAVTDANYNILKFNGKALWGIRLFDSANTAASTRVFRSGRRRIDRTTWRLKMLQELFADEIAKVDPGFFMRLEDSRLHLDDKRENAVYNLFVDKNYTDKEFHQQYPTMYHLRYALATKKGPFDIRLLYLAVQHIAKHRGHFLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEEHKRDLAVLKSMLRGNFLYNKIFRQDGDISYEKYAKGIKGRNQFDFCKDLKKQLECIAEYKKIMQEITSIDAAGTEEERLLFRIANGFAFPKQTTKDNGIIPIQVHLAELKCILDNAEGYLPFLGETDNNSLSVREKIEQIVKFRIPYYVGPLAGTRMSREQGRCWVVRKNEKIYPWNFTEIVNLEESAEKFITNMTAKCTYLFGEDVLPKESLLYSEFMVRNAINNITVDGERLPFDVLEKIFKQLFLAKTSKVTKKTLARFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLAIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKKLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1438 - protein, 1379 aa, unidentified; identical to SEQ ID NO: 1361
  REGION 1..1379: note = Description of Unknown: uncultivated organism with predicted taxonomy: Phascolarctobacterium succinatutens
  REGION 1..1379: note = MG18-86 effector

SEQ ID NO: 1439 - protein, 1379 aa, unidentified
  REGION 1..1379: note = Description of Unknown: uncultivated organism with predicted taxonomy: Phascolarctobacterium succinatutens
  REGION 1..1379: note = MG18-87 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNSEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1440 - protein, 1379 aa, unidentified; identical to SEQ ID NO: 1358
  REGION 1..1379: note = Description of Unknown: uncultivated organism with predicted taxonomy: Phascolarctobacterium
  REGION 1..1379: note = MG18-88 effector

SEQ ID NO: 1441 - protein, 1379 aa, unidentified
  REGION 1..1379: note = Description of Unknown: uncultivated organism with predicted taxonomy: Firmicutes
  REGION 1..1379: note = MG18-89 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSRYCSYDFIGKIKEFNGRRQSSNGKLTYKDVEELYVSPSVKRSIWQTLTILEEIKKIMGCEPKRIFIEMARSKEESKRTDSRLKKLQDLYKKCREENIDFMPRKDEFNVLKTQLSSKKEEDLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMETVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVNYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1442 - protein, 1379 aa, unidentified
  REGION 1..1379: note = Description of Unknown: uncultivated organism with predicted taxonomy: Phascolarctobacterium
  REGION 1..1379: note = MG18-90 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKMMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1443 - protein, 1379 aa, unidentified
  REGION 1..1379: note = Description of Unknown: uncultivated organism with predicted taxonomy: Phascolarctobacterium succinatutens
  REGION 1..1379: note = MG18-91 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEIFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1444 - protein, 1379 aa, unidentified
  REGION 1..1379: note = Description of Unknown: uncultivated organism with predicted taxonomy: Phascolarctobacterium succinatutens
  REGION 1..1379: note = MG18-92 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1445 - protein, 1379 aa, unidentified
  REGION 1..1379: note = Description of Unknown: uncultivated organism
  REGION 1..1379: note = MG18-93 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGRCMYTGERIELASLNDNNLYDIDHIYPRSKTKDDSLSNRVLVKKQVNAAKTDTYPLDAAIRIKMHSFWKLLYDKGFIDERKYERLTRSTQLRDEELAGFISRQLVEMRQSTKAVATILKTAYKHSEVVYVKAGNVSDFRQQFKFVKCREVNDLHHAKDAYLNIVVGNCYYVKFTANPLNFIKKNQDSRSYSLKPEIFYKFNIKRDDDIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1446 - protein, 1379 aa, unidentified; identical to SEQ ID NO: 1423
  REGION 1..1379: note = Description of Unknown: uncultivated organism with predicted taxonomy: Phascolarctobacterium succinatutens
  REGION 1..1379: note = MG18-94 effector

SEQ ID NO: 1447 - protein, 1363 aa, unidentified
  REGION 1..1363: note = Description of Unknown: uncultivated organism
  REGION 1..1363: note = MG18-95 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKEVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVKDYLTEVVQLCKPEIKIPKIKKYSLFKINGFPMHISGRQGKQLIFYVAGQLCINEDSIAYLKKVFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNILQVFLNRKWI

SEQ ID NO: 1448 - protein, 1222 aa, unidentified
  REGION 1..1222: note = Description of Unknown: uncultivated organism with predicted taxonomy: Clostridium sp. CAG:964
  REGION 1..1222: note = MG18-96 effector
RTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNN

SEQ ID NO: 1449 - protein, 1379 aa, unidentified; identical to SEQ ID NO: 1397
  REGION 1..1379: note = Description of Unknown: uncultivated organism with predicted taxonomy: Phascolarctobacterium succinatutens
  REGION 1..1379: note = MG18-97 effector

SEQ ID NO: 1450 - protein, 1379 aa, unidentified
  REGION 1..1379: note = Description of Unknown: uncultivated organism with predicted taxonomy: Phascolarctobacterium succinatutens
  REGION 1..1379: note = MG18-98 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKVFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFNFVKCRDVNDLHHAKDAYLNIVVGNCYHVKFTANPLNFITKNQDNRRYSLKPEFFYKFNIKRDDDIAWLGGADGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1451 - protein, 1379 aa, unidentified; identical to SEQ ID NO: 1357
  REGION 1..1379: note = Description of Unknown: uncultivated organism with predicted taxonomy: Firmicutes
  REGION 1..1379: note = MG18-99 effector

SEQ ID NO: 1452 - protein, 1379 aa, unidentified
  REGION 1..1379: note = Description of Unknown: uncultivated organism with predicted taxonomy: Phascolarctobacterium succinatutens
  REGION 1..1379: note = MG18-100 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFADEELDECEKKSVSFQDDDLNEFEPVLTAALGERYEGLLRFKAIYDWSLLAKILHLDTSKKDKDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1453 - protein, 1379 aa, unidentified
  REGION 1..1379: note = Description of Unknown: uncultivated organism with predicted taxonomy: Firmicutes
  REGION 1..1379: note = MG18-101 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKIYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPADVLEKIFKQLFLEKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSRAIGYEDKAVGEIITIISALRHTNKNLMELLSNYCPYDFIGKIKDFNGSRQSSNGKLTYKDVEELYVSPSVKRSIWQTLTILEEIKKIMGCEPKRIFIEMARSKEESKRTDSRLKKLQDLYKKCKEENIDFMPRKDEFNALKTQLSSKKEDDLRSDKLYLYYTQMGCCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEKCILINQSPTGVFEQEVDLMKL

SEQ ID NO: 1454 - protein, 1378 aa, unidentified
  REGION 1..1378: note = Description of Unknown: uncultivated organism with predicted taxonomy: Firmicutes
  REGION 1..1378: note = MG18-102 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPVQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHESKRIFIEMARSKEESKRTDSRLKKLQDLYKKCREENIDFMPRKDEFNALKTQLSSKKEDDLRSDKLYLYYTQMGRCMYTGESIELASLYDNNLYDIDHIYPRSKTKDDSLSNRVLVKKQVNAAKTDIYPLDAAIRTKMHSFWKLLYDKGFIDERKYERLMRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1455 - protein, 1379 aa, unidentified
  REGION 1..1379: note = Description of Unknown: uncultivated organism with predicted taxonomy: Phascolarctobacterium succinatutens
  REGION 1..1379: note = MG18-103 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGCTTKQKAMQSLLPVQTKQQKAIIQLFSGSKAKLAELFGDAELDECEKKSVSFQDDDLNEFEPVLTAALGERYEGLLRFKAIYDWSLLAKILHLDAGKKDEGEQHLLSECKVQVYEEHKRDLAVLKSMLKGKPLYNKIFRQDGDISYEKYAKGIKGRNQLDFCKDLKKQLEGITEYKKIMQAITSIDDAKTDEERLLFRIANGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLHDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1456 - protein, 1379 aa, unidentified
  REGION 1..1379: note = Description of Unknown: uncultivated organism with predicted taxonomy: Phascolarctobacterium
  REGION 1..1379: note = MG18-104 effector
MQKLKNCDYYIGLDMGDASVGWAVTDTNYNILKFNGKALWGIRLFDSANTAASTRVFRSGRRRIDRTTWRLKMLQELFADEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPQIKKYSLFKINGFPMHISGRTGNRMLFYGAGQLCLDEADVDYLKNALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1457 - protein, 1379 aa, unidentified; identical to SEQ ID NO: 1452
  REGION 1..1379: note = Description of Unknown: uncultivated organism with predicted taxonomy: Phascolarctobacterium succinatutens
  REGION 1..1379: note = MG18-105 effector

SEQ ID NO: 1458 - protein, 1379 aa, unidentified; identical to SEQ ID NO: 1361
  REGION 1..1379: note = Description of Unknown: uncultivated organism with predicted taxonomy: Firmicutes
  REGION 1..1379: note = MG18-106 effector

SEQ ID NO: 1459 - protein, 1379 aa, unidentified
  REGION 1..1379: note = Description of Unknown: uncultivated organism with predicted taxonomy: Phascolarctobacterium succinatutens
  REGION 1..1379: note = MG18-107 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALAMQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFGDAELDECEKKSVSFQDDDLDELEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNAFKTQLSSKKEEDLRSDKLYLYYTQMGRCMYTGERIELASLHDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSAVVYVKAGNVSDFRQQFKFVKCREVNDLHHAKDAYLNIVVGNCYHVKFTASPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEHEVDLMKL

SEQ ID NO: 1460 - protein, 1379 aa, unidentified
  REGION 1..1379: note = Description of Unknown: uncultivated organism with predicted taxonomy: Ruminococcaceae bacterium
  REGION 1..1379: note = MG18-108 effector
MQRLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVAEYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEQCILINQSPTGVFEQEVDLMKL

SEQ ID NO: 1461 - protein, 1379 aa, unidentified
  REGION 1..1379: note = Description of Unknown: uncultivated organism with predicted taxonomy: Phascolarctobacterium succinatutens
  REGION 1..1379: note = MG18-109 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQINAAKTDTYPLDAAIRTKMHSFWKLLYDKGFIDERKYERLTRSTQLRDEELVGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1462 - protein, 879 aa, unidentified
  REGION 1..879: note = Description of Unknown: uncultivated organism with predicted taxonomy: Clostridiales bacterium
  REGION 1..879: note = MG18-110 effector
MQKLKNCDYYIGLDMGDASVGWAVTDTNYNILKFNGKALWGIRLFDSANTTASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERLSLIHISEPTRPLYIS

SEQ ID NO: 1463 - protein, 1379 aa, unidentified; identical to SEQ ID NO: 1357
  REGION 1..1379: note = Description of Unknown: uncultivated organism with predicted taxonomy: Phascolarctobacterium succinatutens
  REGION 1..1379: note = MG18-111 effector

SEQ ID NO: 1464 - protein, 1379 aa, unidentified
  REGION 1..1379: note = Description of Unknown: uncultivated organism with predicted taxonomy: Phascolarctobacterium succinatutens
  REGION 1..1379: note = MG18-112 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWVRLSATLLNSSAIAYDDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1465 - protein, 1379 aa, unidentified
  REGION 1..1379: note = Description of Unknown: uncultivated organism with predicted taxonomy: Clostridiales
  REGION 1..1379: note = MG18-113 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIGQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFCEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1466 - protein, 1379 aa, unidentified
  REGION 1..1379: note = Description of Unknown: uncultivated organism with predicted taxonomy: Phascolarctobacterium
  REGION 1..1379: note = MG18-114 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQNAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFEQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSGKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLNDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYQNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1467 - protein, 1379 aa, unidentified
  REGION 1..1379: note = Description of Unknown: uncultivated organism with predicted taxonomy: Phascolarctobacterium succinatutens
  REGION 1..1379: note = MG18-115 effector
MHKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLDDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1468 - protein, 1379 aa, unidentified
  REGION 1..1379: note = Description of Unknown: uncultivated organism with predicted taxonomy: Phascolarctobacterium succinatutens
  REGION 1..1379: note = MG18-116 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFNIKRDDDIAWLGGEDGTMATVARTMHKNNILFTRQAVEGKGELFKQNPLKANSGQLPLKAGLSVEKYGGYDSLTTAYFAVVKSEGKKGAVQLSIEGIPLVYARQGEDAIKKYLIEVVHLCNPIIKLNKIKKYSLFKINGFPMHISGRQGKQLIFYVAGQLCLDEESIAYLKKAFKYESDLAINEEIIDDKNAAEENKQKAHKRLDFYENTWGISEVANMQLYDILIAKSANNLYKNRPASQTSTLKQQRDMFAKLPLSKQIRVIKEAMNLFKCASATADFKLLGKGSVCGKIQVSTNITKCKQCILINQSPTGVFEQEVDLMKL

SEQ ID NO: 1469 - protein, 1379 aa, unidentified; identical to SEQ ID NO: 1397
  REGION 1..1379: note = Description of Unknown: uncultivated organism with predicted taxonomy: Phascolarctobacterium
  REGION 1..1379: note = MG18-117 effector

SEQ ID NO: 1470 - protein, 1379 aa, unidentified
  REGION 1..1379: note = Description of Unknown: uncultivated organism with predicted taxonomy: Phascolarctobacterium succinatutens
  REGION 1..1379: note = MG18-118 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKILYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1471 - protein, 1379 aa, unidentified; identical to SEQ ID NO: 1420
  REGION 1..1379: note = Description of Unknown: uncultivated organism with predicted taxonomy: Phascolarctobacterium succinatutens
  REGION 1..1379: note = MG18-119 effector

SEQ ID NO: 1472 - protein, 1379 aa, unidentified; identical to SEQ ID NO: 1421
  REGION 1..1379: note = Description of Unknown: uncultivated organism with predicted taxonomy: Phascolarctobacterium succinatutens
  REGION 1..1379: note = MG18-120 effector

SEQ ID NO: 1473 - protein, 1379 aa, unidentified; identical to SEQ ID NO: 1425
  REGION 1..1379: note = Description of Unknown: uncultivated organism with predicted taxonomy: Phascolarctobacterium succinatutens
  REGION 1..1379: note = MG18-121 effector

SEQ ID NO: 1474 - protein, 1379 aa, unidentified
  REGION 1..1379: note = Description of Unknown: uncultivated organism with predicted taxonomy: Phascolarctobacterium
  REGION 1..1379: note = MG18-122 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1475 - protein, 1379 aa, unidentified
  REGION 1..1379: note = Description of Unknown: uncultivated organism with predicted taxonomy: Phascolarctobacterium succinatutens
  REGION 1..1379: note = MG18-123 effector
MQKSKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAVPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKNSVSFQDDDLNEFEPVLTAALGERYEGVLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETDIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1476 - protein, 1379 aa, unidentified
  REGION 1..1379: note = Description of Unknown: uncultivated organism with predicted taxonomy: Phascolarctobacterium succinatutens
  REGION 1..1379: note = MG18-124 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLQLDDKREKAAYNLFVDKSYTDKEFYQQYPTMYHLRYALATQKGPFDVRLLYLAVQHIAKHRGHFLFDNLDASKVNDFNAVFSEVENYVRDEMGIEDWSCQNIDEFAKVLRDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILENAEGYLPFLGETDNNGLSVREKIKQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMVRSKEESKRTDSRLKKLQDLYKKCREENIDFMPRKDEFNALKTMLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRQGKQLIFYVAGQLCINEDSIAYLKKAFKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 1477 - protein, 1379 aa, unidentified; identical to SEQ ID NO: 1391
  REGION 1..1379: note = Description of Unknown: uncultivated organism with predicted taxonomy: Phascolarctobacterium
  REGION 1..1379: note = MG18-125 effector

SEQ ID NO: 1478 - protein, 1379 aa, unidentified
  REGION 1..1379: note = Description of Unknown: uncultivated organism with predicted taxonomy: Phascolarctobacterium
  REGION 1..1379: note = MG18-126 effector
MQKLKNCDYYIGLDMGDASVGWAVTDTNYNILKFNGKALWGIRLFDSANTAASTRVFRSGRRRIDRTTWRLKMLQELFADEIAKVDTGFFMRLEDSRLHLDDKRDKAVYNLFVDKNYTDKDFYQQYPTMYHLRYALATQKGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFIPLKDEFNALKTQLSSKKEEDLRSDKLYLYYTQMGCCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKKGSVQLSIEGIPLVYAKQGEKAVQDYLTEVVQLCKPEIKIPKIKKYSLFKINGFPMHISGRTGKQLIFYGAGQLCIADDVADYLKKALKYETDIAEKEKTLADQNADEIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1479 - protein, 1379 aa, unidentified; identical to SEQ ID NO: 1436
  REGION 1..1379: note = Description of Unknown: uncultivated organism with predicted taxonomy: Phascolarctobacterium
  REGION 1..1379: note = MG18-127 effector

SEQ ID NO: 1480 - protein, 1379 aa, unidentified
  REGION 1..1379: note = Description of Unknown: uncultivated organism with predicted taxonomy: Phascolarctobacterium
  REGION 1..1379: note = MG18-128 effector
MQKLKNCDYYIGLDMGDASVGWAVTDTNYNILKFNGKALWGIRLFDSANTAASTRVFRSGRRRIDRTTWHLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDKIENIIRWITLFCDEKKMLVTKIKNTYPHISDDKIKAIKKLKYKDWGRLSATLLNSSAIAYEDDAFGERVTIISALRHTNKNFMELLSNYCSYDFIGKIKDFNGSRQSSNSKLTYKDVEELYVSPSVKRSIWQTLTILEEIKKIMGHEPKRIFIEMARSKEESKRTDSRLKKLQDLYKQCREENIDFMPHTDELNAFKIQLSSKKEDDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1481 - protein, 1379 aa, unidentified
  REGION 1..1379: note = Description of Unknown: uncultivated organism with predicted taxonomy: Phascolarctobacterium succinatutens
  REGION 1..1379: note = MG18-129 effector
MQKLKNCDYYIGLDMGDASVGWAVTDTNYNILKFNGKALWGIRLFDSANTAASTRVFRSGRRRIDRTTWRLKMLQELFAEKIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERNEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGITEYKKIMQEITSIDDAKTEEERVLFRITNGFAFPKQTTKDNGIIPIQVHLAELKCILDNAEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLAYKDVEELYVSPSVKRSIWQTLTILEEIKKIMGCEPKRIFIEMARSKEESKRTDSRLKKLQDLYKKCREENIDFMPRKDEFNVLKTQLSSKNEEDLRSDKLYLYYTQMGRCMYTGEIIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1482 - protein, 1379 aa, unidentified
  REGION 1..1379: note = Description of Unknown: uncultivated organism with predicted taxonomy: Phascolarctobacterium succinatutens
  REGION 1..1379: note = MG18-130 effector
MQKLQNKDYYIGLDMGDASVGWAVTDANYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRRDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1483 - protein, 1379 aa, unidentified
  REGION 1..1379: note = Description of Unknown: uncultivated organism with predicted taxonomy: Phascolarctobacterium succinatutens
  REGION 1..1379: note = MG18-131 effector
MQKLKNCDYYIGLDMGDASVGWAVTDTNYNILKFNGKALWGIRLFDSANTAASTRVFRSGRRRIDRTTWRLKMLQELFAEEIAKVDTGFFMRLEDSRLQLDDKREKAVYNLFVDKSYTDKEFYQQYPTMYHLRYALATQAGPFDVRLLYLAVQHIAKHRGHFLFDNLDASKVNNFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKNLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGRRQSSNGKLTYKEVEDLYVSPSVKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1484 - protein, 1379 aa, unidentified
  REGION 1..1379: note = Description of Unknown: uncultivated organism with predicted taxonomy: Phascolarctobacterium succinatutens
  REGION 1..1379: note = MG18-132 effector
MQKLKNCDYYIGLDMGDASVGWAVTDTNYNILKFNGKALWGIRLFDSANTAASTRVFRSGRRRIDRTTWRLKMLQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGTVQLSIEAIPLVYAKQGEIAVQKYLTKVVQLCKPEIMLPKIKKYSLFKINGFPMHISGRTGNRMLFYGAGQLCLDEADVDYLKKALKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1485 - protein, 1235 aa, unidentified
  REGION 1..1235: note = Description of Unknown: uncultivated organism with predicted taxonomy: Phascolarctobacterium succinatutens
  REGION 1..1235: note = MG18-133 effector
VRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTISYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMHRKDEFNALKTQLSSKKEEDLRSDKLYLYYTQMGRCMYTGERIELASLYDNNLYDIDHIYPRSKTKDDSLSNRVLVKKQVNAAKTDIYPLDAAISTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEEAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1486 - protein, 1348 aa, unidentified
  REGION 1..1348: note = Description of Unknown: uncultivated organism with predicted taxonomy: Clostridiales
  REGION 1..1348: note = MG18-135 effector
MDQNKEYYIGLDGGTDSVGWAVLNPDYTVVKKRGKSLWGVRLFESGQTAAERRLARSARRRTDRRKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEDRFSLLQYAYAAYNWAVFARLLPEGKTISEVKTEEYEAYKADLRALKQLVKQYAPDQYYRVFRSAKIKGNYASYVGKTNCGNEKSNPEPCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDESACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVIRKVCALNFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFVEMARGASPEQKNKRTVSRKDQLLALYKACKEDARDWCSELEALPEDKLRSDKLYLYYTQMGRCMYSGELIRLDDLMHDTANQLYDIDHIYPQSKTKDDSLTNRVLVKRQLNAIKSNDYPLPQAMRQTALWKALLEKGLISKQKYLRLTRTTPFTGEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYKLQPLKKGKGQLPLKSSDEHPQPINRYGGYNEVKGAYFVLAAYLKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLFLQGKFLLEKRDVFAALNPEAQVRQLMEILHLFQCNPVAANLSELGGAAHAGILLASKNIDGKVPVSIVHQSVTGYFSQEVCLNDL

SEQ ID NO: 1487 - protein, 1348 aa, unidentified
  REGION 1..1348: note = Description of Unknown: uncultivated organism with predicted taxonomy: Clostridiales
  REGION 1..1348: note = MG18-136 effector
MDQNKEYYIGLDGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWSVFARLLPEGKTISEVKTEEYEAYKADLRALKQLVKQYAPDQYYRVFRSAKIKGNYASYVGKTNCGNEKSNPESCKPEEFFAFLKKELKPLWSQSIPAAASLAAKLESGTLLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASIAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1488 - protein, 913 aa, unidentified
  REGION 1..913: note = Description of Unknown: uncultivated organism with predicted taxonomy: Dorea sp. OM02-2LB
  REGION 1..913: note = MG18-137 effector
NMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1489 - protein, 988 aa, unidentified
  REGION 1..988: note = Description of Unknown: uncultivated organism with predicted taxonomy: Phascolarctobacterium
  REGION 1..988: note = MG18-138 effector
MQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1490 - protein, 1218 aa, unidentified
  REGION 1..1218: note = Description of Unknown: uncultivated organism with predicted taxonomy: Phascolarctobacterium succinatutens
  REGION 1..1218: note = MG18-139 effector
FLFDNLDASTVNDFNAVFSEVENYVHDEMGLEDWSCQNKDALAKVLCDVNLGRTTKQKAMQSLLPAKSKQQKAILQLFSGGKAKLAELFDDEELDDCEKKSISFQDDDLDEIEPVLTAALGERYEGLLRFKAIYDWSLLAKILHLDTGKKEEGEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIISIQVHLAELKFILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1491 - protein, 947 aa, unidentified
  REGION 1..947: note = Description of Unknown: uncultivated organism with predicted taxonomy: Phascolarctobacterium succinatutens
  REGION 1..947: note = MG18-140 effector
VHLAELKFILDNAEGYLPFLGETDNNGLSVREKIEQIVKFRIPYYVGSLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDYEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQELYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 1492 - protein, 947 aa, unidentified
  REGION 1..947: note = Description of Unknown: uncultivated organism with predicted taxonomy: Firmicutes
  REGION 1..947: note = MG18-141 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1493 - protein, 1056 aa, unidentified
  REGION 1..1056: note = Description of Unknown: uncultivated organism with predicted taxonomy: Clostridium sp. CAG:964
  REGION 1..1056: note = MG18-142 effector
AVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERVLFRITNGFAFPKQTTKDNGIIPIQVHLAELKCILDNVEGYLPFLGETDNNGLSVREKIEQIVKFRIPYYVGPLAGTRMSREQGRYWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRSDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYACLLYT

SEQ ID NO: 1494 - protein, 1348 aa, unidentified; identical to SEQ ID NO: 1486
  REGION 1..1348: note = Description of Unknown: uncultivated organism with predicted taxonomy: Clostridiales
  REGION 1..1348: note = MG18-143 effector

SEQ ID NO: 1495 - protein, 1348 aa, unidentified; identical to SEQ ID NO: 1487
  REGION 1..1348: note = Description of Unknown: uncultivated organism with predicted taxonomy: Firmicutes
  REGION 1..1348: note = MG18-144 effector

SEQ ID NO: 1496 - protein, 951 aa, unidentified
  REGION 1..951: note = Description of Unknown: uncultivated organism with predicted taxonomy: Dorea sp. OM02-2LB
  REGION 1..951: note = MG18-145 effector
GPELVLWVGVILLRRQRSGENAAIPYQAHLQELQIILKNMQQFYPFLQKADENGFTPAYKIEKLLTFRIPYYVGPLNDAHKEKGFCWIVKKADMPVLPWNFDQVVDENACEDAFIGRMSATCTYLVGENVLPQNSPLYCRFMVLNELNNLRIRGEKITPALKQAIFTQLFCAGKGGKVTQKKLLDFLHSQGIDANKQDISGIDGDFKASMAPAVKLQSIFTEPLPPETLERLAFALTVSGESRKMLQNRIRAILPNADNAVVRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGASPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQAMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQLNPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 1497 - protein, 947 aa, unidentified; identical to SEQ ID NO: 1491
  REGION 1..947: note = Description of Unknown: uncultivated organism with predicted taxonomy: Phascolarctobacterium succinatutens
  REGION 1..947: note = MG18-146 effector

SEQ ID NO: 1498 - protein, 1218 aa, unidentified; identical to SEQ ID NO: 1490
  REGION 1..1218: note = Description of Unknown: uncultivated organism with predicted taxonomy: Firmicutes
  REGION 1..1218: note = MG18-147 effector

SEQ ID NO: 1499 - protein, 1306 aa, unidentified
  REGION 1..1306: note = Description of Unknown: uncultivated organism with predicted taxonomy: Lactobacillus oryzae
  REGION 1..1306: note = MG18-148 effector
LQELFAEEIAKVDPGFFMRLEDSRLHLDDKRDKAVYNLFVDKNYTDKDFYQQYPTMYHLRYALATQAGPFDVRLLYLAVQHIAKHRGHFLFDNLDASKVNDFNAVFSEVENYVRDEMGIEDWSCQNIDELAKVLCDVNLGRTTKQKAMQSLLPAQTKQQKAIIQLFSGGKAKLAELFVDAELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFIIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDIYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEKAVQNYLTDVLQLCEPEIKIPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1500 - protein, 947 aa, unidentified
  REGION 1..947: note = Description of Unknown: uncultivated organism with predicted taxonomy: Phascolarctobacterium
  REGION 1..947: note = MG18-149 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVKKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1501 - protein, 947 aa, unidentified
  REGION 1..947: note = Description of Unknown: uncultivated organism with predicted taxonomy: Firmicutes
  REGION 1..947: note = MG18-150 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKISKVTKKTLERFFRQENISFQNIGGIDDKINASMKSYNDFRRIFGEDYIQLHRDKIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKDFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDDNLYDIDHIYPRSKTKDDSLSNRVLVNKEVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQNPLKAKNGQLPLKAGLSVEKYGGYNSLSTAYFAVVKSEGKKGAVQLSIEAIPLVYAKQGEKAVQDYLTEVVQLCNPEIRIPKIKKYSLFKINGFPMHISGKTVKQIIFYAAGQLCLADDVADYLKKALKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 1502 - protein, 781 aa, unidentified
  REGION 1..781: note = Description of Unknown: uncultivated organism with predicted taxonomy: Phascolarctobacterium
  REGION 1..781: note = MG18-151 effector
FQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPHTDELNAFKIQLSSKKEDDLRSDKLYLYYTQMGRCMYTGERIELASLYNDNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTDISNVKQCILINQSPTGIFEQEVDLMKL

SEQ ID NO: 1503 - protein, 947 aa, unidentified; identical to SEQ ID NO: 1500
  REGION 1..947: note = Description of Unknown: uncultivated organism with predicted taxonomy: Phascolarctobacterium succinatutens
  REGION 1..947: note = MG18-152 effector

SEQ ID NO: 1504 - protein, 1010 aa, unidentified
  REGION 1..1010: note = Description of Unknown: uncultivated organism with predicted taxonomy: Firmicutes
  REGION 1..1010: note = MG18-153 effector
VHCGFFILFFVQVDYTIYHKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTLLSSQKEEDLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIKIPKIKKYSLFKINGFPMHISGRTGKQLVFYGAGQLCIADDVADYLKKALKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 1505 - protein, 1056 aa, unidentified
  REGION 1..1056: note = Description of Unknown: uncultivated organism with predicted taxonomy: Phascolarctobacterium succinatutens
  REGION 1..1056: note = MG18-154 effector
VQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCYYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNALKTQLSSKKEENLRSDKLYLYYTQMGRCMYTGERIELASLYDNNLYDIDHIYPRSKTKDDSLSNRVLVKKQVNAAKTDTYPLDAAIRTKMHSFWKLLYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGKQLIFYGAGQLCIADDVADYLKKALMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 1506 - protein, 1046 aa, unidentified
  REGION 1..1046: note = Description of Unknown: uncultivated organism with predicted taxonomy: Phascolarctobacterium succinatutens
  REGION 1..1046: note = MG18-155 effector
LAVLKSMLKGKPLYNKIFRQDGDISYEKYAKGIKGRNQLDFCKDLKKQLDGIAEYKKIMQEITSIDAAGTEEERLLFRIANGFAFPKQTTKDNGIIPIQVHLAELKCILDNAEGYLQFLGETDNNGLSVREKIEQIVKFRIPYYVGPLAGTRMSREQGRCWVVRKNEKIYPWNFTQVVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 1507 - protein, 759 aa, unidentified
  REGION 1..759: note = Description of Unknown: uncultivated organism with predicted taxonomy: Clostridium sp. CAG:964
  REGION 1..759: note = MG18-156 effector
VHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSSSVKRSIWQTLTILKEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYNDNLYDIDHIYPRSKTKDDSLSNRVLVKKQVNAAKTDIYPLDAAIRTKMHSFWKLIYDKGFIDERKYERLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFK

SEQ ID NO: 1508 - protein, 988 aa, unidentified
  REGION 1..988: note = Description of Unknown: uncultivated organism with predicted taxonomy: Ruminococcaceae bacterium
  REGION 1..988: note = MG18-157 effector
MYHLRYALATQAGPFDVRLLYLAVQHIAKHRGHFLFDNLDASKVNDFNAVFSEVENYVRDEMGIEDWSSQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKVQVYEDHKRDLAVLKSMLKGKPLYNKIFRQDGDISYEKYAKGIKGRNQIDFCKDLKKQLEGIAEYKKIMQEITNIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKHEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGREPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKEVNAAKTDIYPLDAVIRTKMHSFWKLLYDKGFIDERKYERLTRSTQLRDEELAGFISRQLVETRQSTKAVAAILKTAYKHSEIVYVKAGNVSDFRQKFEFVKCRDVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGHWPLKAG

SEQ ID NO: 1509 - protein, 814 aa, unidentified
  REGION 1..814: note = Description of Unknown: uncultivated organism with predicted taxonomy: Clostridium sp. CAG:964
  REGION 1..814: note = MG18-158 effector
FITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKMLVTKIKNTYPQIADDQIKAIKKLKYKDWGRLSATLLNSSAIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLNSKKEDDLRSDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVATILKTAYQNSEVVYVKAGNVSDFRQQFKFVKCREVNDLHHAKDAYLNIVVGNCYHVKFTANPLNFITKNQDNRRYSLKPEIFYKFSIKRDGEIAWLGGEDGTMATVARTMHKNNILFTRQAVEGKGELFDQQPLKAKGGQLPLKAGLSIEKYGGYNSLTTAYFAVVKSEGKKGAVQLSIEAIPLVYAKQGEIAVQKYLTEVVQLCKPEIMLPKIKKYSLFKINGFPMHISGRTGNRMLFYGAGQLCLDEADVDYLKKALKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASA

SEQ ID NO: 1510 - protein, 767 aa, unidentified
  REGION 1..767: note = Description of Unknown: uncultivated organism with predicted taxonomy: Phascolarctobacterium succinatutens
  REGION 1..767: note = MG18-159 effector
MKSYNDFRRIFGEDYIQLHRDEIENIIRWITLFCDEKKMLVTKIKNTYPQISDDEIKAIKKLKYKDWGRLSTTLLNSSTIAYEDKAFGELVTIISALRHTNKNFMELLSSYCSYDFIGKIKEFNGSRQSSNGKLTYKDVEELYVSPSVKRSIWQTLTILEEIKKIMGCEPKRIFIEMARSKEESKRTDSRLKKLQDLYKKCREENIDFMPRKDEFNTLKTQLSSKKEDDLRIDKLYLYYTQMGRCMYTGEKIELASLYDNNLYDIDHIYPRSKTKDDSLSNRVLVKKQVNAAKTDTYPLDAAIRTKMHSFWKLLYDKGFIDERKYQRLTRSTQLRDEELAGFISRQLVETRQSTKAVAAILKTAYQNSEVVYVKAGNVSDFRQQFKFVKCREVNDLHHAKDAYLNIVVGNCYHVKFTANPLNFITKNQDNRRYSLKPEIFYKFSIKRDSEIAWIGGKDGTITTVTKTMHKNNILFTRQPVEGKGELFKQQPLKAKSGQLPLKAGLSVEKYGGYDSLTTAYFALVKSEGKKGAVQLSIEGIPLVYAKQGEIAVQKYLTEVVQLCKPEIMLPKIKKYSLFKINGFPMHISGRQLKQLQFYVASQLCIDEYSIAYLKKAFKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 1511 - protein, 815 aa, unidentified
  REGION 1..815: note = Description of Unknown: uncultivated organism with predicted taxonomy: Clostridiales
  REGION 1..815: note = MG18-160 effector
DVLPKQSPLYSRYMVLNELNNIRVDGIRLPVEVKQQAYKDLFLSLPKVSMKKFREYLRTINIQGEISGIDGEFQGSLKPHIDLKRIFGPARNLGAMGEDIIRWIVLFGEAKNILRKKIAEKYDLTEEQMKGVLRLHYSGWGRFSEKFLNGIRDVNKETGEVGDTVIESLWNSSQNLMELLGREHHFLGAISMHNDAFGSSDRITYQTVQDLYVAPAVKRQIWQALTIVKELKGVMGREPKRVFIEMARGPGEKKRTVSRKDALIELYKTLKSDERDWINEIAVQPEDRFRSDRLYFYYLQLGKCLYTGKPIDLDQIYNEMVYDVDHIYPQSKVKDDSLVNRVLVDSTKNKEKSDRYPIDKEIRDRMKPFWKMLLQQGFMEKEKYERLTRSTPFSDNELAEFIARQLVETRQSTKAVAEILQQVYPLSKIVYVKAGLVADFRRYMGHVKCREVNDYHHAKDAYLNIVAGNIYHTRFTDNPYNFIKEAKDKDQKYSLKLEKLLTRDIRRGDITAWDTTGNKTRGVVEKVLARNDIRFTRYPYTEKGQLFDVTLMKKGLGQLPIKANLPIEKYGGYNKVKGAYFMLVEHTDKKGKRIRTLKDVPVHLASQLATDVKKQEYCLDLGMKDPVIRYSKIKMKSLVEVDGFRMHISGRKGDALVLSHAHELVIGEYWEQYIKKLVKFRERAQAFSKSNRGMNLKITTYDGIDGNNNMELYDLFVSKLNNTIYQLKLSKQGTDLLDERERFLNLTIEEQVGILLEILNFFKCNRTSSDLKLLGKGGQAGNLSINSTISGYQTFKLINQSPTGVFEESVDLLKV

SEQ ID NO: 1512 - protein, 1098 aa, unidentified
  REGION 1..1098: note = Description of Unknown: uncultivated organism with predicted taxonomy: Firmicutes
  REGION 1..1098: note = MG21-1 effector
MTSHSIRYTLGLDIGIASVGWAVLRNGSDSEPYRIETLGVRIFDKAEVPKTGASLAAPRREARSSRRVVRRRRHRKERIKYLIEQEGIMTQAEMTRLFQNSSFEKSVYEIRVEALDRMLTREETVRLLIHFAQRRGYKSNSKAEEAKDNENGVIKQAISQNKQAMKAHGYRTFGEMLLMDERFYYTQPDGSRIFIPHNKASDYKVTAERSMLADELHMIFAAQRSLGSLWFSDTFETAYMDVWSSQRSFDEGPGGDSPYGGSQIEKMLGTSSDGESRAPKASYSAEYFRLLQDVNHLRIVSLDGTSSPLTQEQRDIVVAASKKSGTLTYTQLRKKLALADDQYFNALYYGDKTAVEVEKKRFGHLQFYHQLRTALDTVEKGAADTLTWAQRDEIARILTVYKADVRRTDELRKAGIPAEYIRALLPLSPTRAMHLSVTAIRKMIPHLEAGMSYSDAYSKAYGNQSTASAAPKKNKLSLNDIEEITNPVVRRAVSQSIKVINAIVRQYGAPERVRIELAREMGKNFKDRGKIAKSQADHAAKNERIKAQISEYKSDHITGQDIVKFKLFKEQDGICLYSGKSLDIARLFEPGYVDVDHIIPYSISFDDSYNNKVLVLSSENRQKGNRIPYAYFGQNSDRWEKYETLVSNTVRSYRKRKNLLLKSLSEAQIDGFKQRNLQDTQYLSKVIFRLIENHLQFAETAPGKKHTQPVNGAITAQVRKRLGIEKIREDGDLHHAVDAAVIACITPGMIQKITKYAQNHERFYATAKGYVDIETGEVLTRSEYEAMDDIRFPEPWPGFRSELEARVSEHPQEAIARLKLPHYENSEEIRPIFVSRMPNHKVTGAAHLETIRSKKGGAGSTVTKTALPDLKLDKNGEIAGYYRKEDDPLLYEALKARLKAFGGDGKKAFAEPFHKPKHNGEPGPIVKKVKIQESATLTVPVNHGIAANGSMVRLDVFHVDGDGYYFVPIYTSDTVKPELPNRAVVAGRRVQEWKVMDDSYFKFSLYPKDLIRIRSKKGIKLKAVNRNADLQEYSTNDCLCYFVKFNISTGALSVENHDRKFEQPGLGGKTLLSIEKYQVDVLGNYSPVALPEKRMKFR

SEQ ID NO: 1513 - protein, 915 aa, unidentified
  REGION 1..915: note = Description of Unknown: uncultivated organism with predicted taxonomy: Roseburia sp. AM23-20
  REGION 1..915: note = MG21-3 effector
HNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDG

SEQ ID NO: 1514 - protein, 1166 aa, unidentified
  REGION 1..1166: note = Description of Unknown: uncultivated organism with predicted taxonomy: Clostridiales
  REGION 1..1166: note = MG21-4 effector
MHYILGLDIGITSIGWAVIESDQDGAPFKIADLGVRIFKAAEQPKTGSSLALPRRSARSLRRRLWRKAHRKERIKLLLDRVGLITKENLEKLFSASSFEKDVYTLRSEGLDRKLNNEEWARVLYHLAQRRGYRSSSKAEEADTKNDAGKLLKAVKNNSDKMAQNNFRTVGEMFCKDSSDLFQVKDGSGHVIGRKTHNTSGVYDLTVARTFIEEEAHKLFAAQRQFGNAFATENIENEYCEILLSQRHFSDGPGGERTFKFDLRGNCTFEKDELRAFKACYTFEFFKLLQDINHLRIIPEYRKGSNKQTRPLTPEERQKIIDLCLKSSSIDFSKLRKELKLADDEIFNRVGYDVKKKKSKKKDAEEQPEEQLTPEQQRTKCEEATKFTQMQSYHEMRKALDKVAKGTISKFSHDKLDEIGEILSLYKADDKRRERLEQIGLSNEEIEALLPLTFTKAGNLSLGAMRKLIPYLEQGLTYDKACEIVYGDHRAQYKGERMPLLSFGKLKEEGALDSVNNPVVLRAIAQTFKVVNAIIRRYGSPQAIHIELARDMKRNFADRQDIKSKQKDNWSENNRRREKVEEIKGSVATGQDIVKMKLYEDQNGVCLYSGKQLELHRLFEVGYAEVDHIVPYSKCFDDSYNNKVLVFSSENQRKGNRLPLEYMLAEGDEDKLDDYVTLVEANIKNTRKKQRLLKPCLTEQDITDWKARNLTDTQYITKAVADILRNYLAFEEDSPFIKKPVRSINGAVTDQVRKRLGLQKHREEGDLHHAMDAAVIAVTTDGYINRISRYTQRREFGKRIGCYKDKQTGEKVEIERQKGQAPLYIDPETGEKLTEQVFDHKYAPTFPAPWKEFTKELKARMAPNADEAIRQLYLPSYGSEEIKPIFVSQMPDRKISGQAHAETIRSARIDVDESGKERIIAVAKTPLTSLKLDKDGEIDGYYMPSSDRLLYEELKNRLKAYGNAEQAFKEPVYKPKKDGSQGPRVYKVKTYKTTTSNVKVAGGIADNGSMVRIDVFHIKEGKDKGYYFIPIYVADTIKQKLPQKAVVAAKSIDQWKEMDDEDFIFSLYPGDLVRVEHKKDIVFKSTDKNSSDTISCKNLLTYYSGANISTGAITITNHDRSYIVHGLGIKTLQLLEKYEVDVLGNYHKVRLPEKRQAFNLKYSQKKQ

SEQ ID NO: 1515 - protein, 1166 aa, unidentified; identical to SEQ ID NO: 1514
  REGION 1..1166: note = Description of Unknown: uncultivated organism
  REGION 1..1166: note = MG21-5 effector

SEQ ID NO: 1516 - protein, 1166 aa, unidentified; identical to SEQ ID NO: 1514
  REGION 1..1166: note = Description of Unknown: uncultivated organism
  REGION 1..1166: note = MG21-6 effector

SEQ ID NO: 1517 - protein, 1136 aa, unidentified
  REGION 1..1136: note = Description of Unknown: uncultivated organism with predicted taxonomy: Clostridium sp. CAG:571
  REGION 1..1136: note = MG21-7 effector
MGYRIGLDIGITSVGWSVIEDDSNGNPIRIIDLGSRIFDAAEKPKDGSPLAKERRDARGLRRRLRRKKYRVERTKRLLERYDIITKKEVDEMYANKAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKGVTYDKAVDKVYEDFRGTVDTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNANFVRKVWTVNGKLTAHIRKRLGIEKVRDGDTHHAVDATVIAITTQNMINRLTRYYQYVDGRYMNNKGEYIDTYTGEIINAKEYEEKYGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPENCKRDDRLLYEALKNRLIEFNGDATKAFSEPFYKPKSDGTRGPVVNKVKIEANTTMGVKLNDNKAFAANGDCVRLDIFYVENEGYYFIPIYVSDTVKKELPNKACVAGKKYADWKEMRDENFIFSIYPKDLIYIQGKNKIKLNPVIKDKDSIEVEEILAYYVKAGISVAQIAIQTNDNKYNQSSLGIKNLKKLEKYEVDILGNYHKVKLPEKRLPFNINKK

SEQ ID NO: 1518 - protein, 1121 aa, unidentified
  REGION 1..1121: note = Description of Unknown: uncultivated organism with predicted taxonomy: Clostridiales
  REGION 1..1121: note = MG21-8 effector
MGGNAMKKEQKHCHYTLGLDIGIASIGWAVLGNNEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1519 - protein, 1093 aa, unidentified
  REGION 1..1093: note = Description of Unknown: uncultivated organism
  REGION 1..1093: note = MG21-9 effector
MHYILGLDIGITSIGWAVIESDQDGKPFKIADLGVRIFKAAEQPKTGASLALPRRSARSLRRRLWRKAHRKERIKLLLDKVGLISKENLEKLFSASSFEKDVYTLRSEGLDRKLNNKEWARVLYHLAQRRGYRSSSKAEEADTKNDAGKLLKAVKNNSDKMAQNNFRTVGEMFCKDSSDLFQVKDGSGHVIGRKTHNTSGVYDLTVARIFIEEEAHKLFAAQRQFGNAFATESIENEYCEILLSQRHFSDGPGGERTFKFDLRGNCTFEKDELRAFKACYTFEFFKLLQDINHLRIIPEYRKGSNKQTRSLTPEERQKIIDLCLKSPDVKFSKLRKELKLEDDELFNRVNYDVKKKKSKKKDAEEQPEEQLTPEQQRTKCEEAAKFTQMQSYHEMRKALDKVAKGTISKFSHDKLDEIGEILSLYKADDKRRERLEQIGLSNEEIEGIGGKLFVLTGNLSLIAMRKLIPYLEQGLTYDKACEIVYSDHRAQYKGERMPLLSFGKLKEEGALDSVNNPVVLRAIAQTFKVVNAIIRRYGSPQAIHIELARDMKRNFTDRQDIKKKQDSNWSYNDKIREKVEELKGSAATGQDIVKMKLYEEQDGYCLYSGKQLDIRRLFEVGYAEVDHIVPYSKCFDDSYNNKVLVFSSENQRKGNRLPLEYMLAEGDEDKLDDYVTLVEARIKNTRKKQRLLKPCLTAEDSNDWKERNLTDTQYITKAVADILRNYLAFEEDSPFIKKPVRSINGAVTDQVRKRLGLQKHREEGDLHHAMDAAVIAVTTDGYINRISRYTQRREFGKRIGCYVDLETGEKLTKQAFEQKYEPTFPAPWNKFTKELKARMAPNADEAIRQLYLPSYGSEEIKPIFVSQMPDRKVSGQAHAETIRSARIDVDGNGKERIIAVAKTPLTSLKLDKDGEIDGYYMPSSDRLLYEELKNRLKAYGNAEQAFKEPVYKPKKDGSQGPRVYKVKTWKTTTSNVKVAGGIADNGSMVRIDVFHIKEGKDKGYYFVPIYVADTIKKELPQKAVVAAKPIDHWKEMDDKDFIFSLYPGDLIRVEHKKDIVFKSTDKNSSDTISCKNLLTYYVFANISTGAIAI

SEQ ID NO: 1520 - protein, 1136 aa, unidentified
  REGION 1..1136: note = Description of Unknown: uncultivated organism with predicted taxonomy: Clostridiales
  REGION 1..1136: note = MG21-10 effector
MGYRIGLDIGITSVGWSVIEDDSNGNPIRIIDLGSRIFDAAEKPKDGSPLAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRENEILMQSKGYRTVAEMYLKDDKFKAKNKKGEILVDKDGTPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTINKEKRELRSEEKEKLKELVFSKVTVTYSDVRKTLQLEPNQRFNMFTYRDLLNYTEETNKEIEKEKKLKEFESYKKIKTALNHIEKNYITKLTTDELDEIGYAVTVYKNDDKRKEYLENHTTNLSKEAIEELLNLSFSKVGNLSLKAMKKIIPELEKGVTYDKAVDKVYEDFRGTVNTQKKRKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNVEEYEIRVNTLIRNNKKKQNLLRQDFTREDAEDWKERNLNDTKYICKYMYNLIRNHLEFSDNPNFVRKVWTVNGKLTAHIRKRLGIEKVRDGDTHHAVDATVIAITTQNMINRLTRYYQYVDGRYMNNKGEYIDIYTGEIINAKEYEEKNGIYFPEPWPKFRKELDIRTNCKTRERMIECLEAEKIYTYEDYDDVEPIFVSRMPRRKVTGTAHLDTIRGIKEKDGELKTITKTELTKLKLKDGEIEGYPDNCKRDDRLLYEALKNRLVEFNGDAAKAFSEPFYKPKSDGTRGPIVNKVKIEANTTMGVTLNDGKAFAANGDCVRLDIFYVENEGYYFIPIYVSDTVKKELPNKACVAGKKYADWKEMKEKDFIFSIYPKDLLYIQGKNKIKLNPVVKDKDPIEVEEILAYYLKIDISTATIEIKSNENKYVKRGLGGKGLKKLEKYEVDILGNYHKVKLPEKRLPFNINKK

SEQ ID NO: 1521 - protein, 1136 aa, unidentified
  REGION 1..1136: note = Description of Unknown: uncultivated organism with predicted taxonomy: Clostridiales
  REGION 1..1136: note = MG21-11 effector
MGYRIGLDIGITSVGWSVIEDDSKGNPIRIIDLGSRIFDAAENPQDGSALAKERRDARGLRRRLRRKKHRIERTKRLLERYDIITKKEIDEMYANQAHVKHLYNVYELRVLGIEQRLTNKELARVLISLVKKRGYKSNSKAEESNGEAGKLLTATRDNEILMQSKGYRTVAEMYLKDDKFKAKDKNEEILVDKDGIPLLKIKNSTGDYKNTTLRKLLIEEIKLILNKQKELNSKITDDFITEYLKIFESQRNFDDGPGFPSPYGGNLIENMLGNCTFEKEEKRAPKATYTFEYFKFLQTLNHIKIETINIKDDGTIKKEKRELTSDEKEKLKELVFSKVTVTYSDVRKTLQLEPNQRFNMFTYKDLLNYTEETNKEIEKEKKLKEFESYKKIKTALNHIEKNYITKLTTDELDEIGYALTVYKNDDKRKEYLENHTTNLSKEAIEELLKLSFSKVGNLSLKAMKKIIPELEKGVTYDKAVDKVYEDFRGTVNTQKKSKLRLKDFEQEISNPVVRRGLSQAIKVLNAITLRYNEKFGKPDVVVVELARELGKNFADRRTIEKRQSDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDSEDWKERNLNDTKYICKYMYNLIRNHLEFSDNTNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECIEAERIYTYEDYNDVEPIFVSRMPRRKVTGPAHVATIRGVKEKDGELKKITKTELTKLKLKDGEIEGYPENCKRDDRLLYEALKNRLIEFNGDATQAFSEPFYKPKSDGTRGPVVNKVKIEANTTMGVILNDKKAFAANGDCVRLDVFYVENEGYYFIPIYVSDTVKKELPNKACVAGKKYADWKEMKDEDFIFSIYPKDLIYIQGKNKIKLNPVIKDKEPIEVEEIFAYYVKAGISSAAITIQTNDSKYVQPSLGIKSLKKLEKYEVDILGNYHKVKLPEKRLPFNINKK

SEQ ID NO: 1522 - protein, 1088 aa, unidentified
  REGION 1..1088: note = Description of Unknown: uncultivated organism with predicted taxonomy: Helicobacter sp. MIT 11-5569
  REGION 1..1088: note = MG21-12 effector
MHYILGLDIGITSIGWAVIESDQDGVPFKIADLGVRIFKAAEQPKTGASLALPRRSARSLRRRLWRKAHRKERIKFLLDKVGLISKENLEELFLASGFEKDVYTLRAEGLDRKLNNEEWARVLYHLSQRRGYKSSSKAEESDKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQTRPLTPEERQKIIDLCLKSPSIDFSKLRKELKLADNELFNRVNYDVKKKKGKKKDTEEQSEEQLTPEQQRLKCEKAAKFQQMQSYHEICKALDKVAKGTISKLSHDQLDAIGEALSLYKADDKRRERLEQIVLSNEEIEALLPLDSTKAGNLSLIAMRKLIPYLEQGLTYDKACEQVYGDHRAQYNGERMPLLSFGNLKEEGALDSVNNPVVLRAIAQTFKVVNAIIRRYDSPQAIHIELARDMKRNFADRQDIKKKQDNNWSCNDRIRQKVEEYKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPDRKISGQAHAETIRSARVDVDESGKERIIAVAKTPLTSLKLDKDGEIENYYMPSSDRLLYEELKNRLKAYNNDPKEAFKEPVYKPKKDGSQGPRVYKVKTWKTTTSNVKVAGGIADNGSMVRIDVFYVKEGKDKGYYFIPIYVADTIKKELPQKAVVQGESMNNWKEMDDKDFIFSLYPGDLVRVEHKKNIEIGRAS

SEQ ID NO: 1523 - protein, 1132 aa, unidentified
  REGION 1..1132: note = Description of Unknown: uncultivated organism with predicted taxonomy: Clostridium
  REGION 1..1132: note = MG21-13 effector
MGYRIGLDIGITSVGWAAIEDDANGNPKRIIDLGSRIFEAAEKPKDGSPLAKDRRDARGLRRRLRRKKHRVERTKRLLERYNIITKKELEDLYENYRFQYNVYELRVMALDEKITNKDLARILISMVKKRGYKSNSKSEEIASGSDAGKLLTATKENEELMKEKGYRTVAEMYLKDDKFKLKNSNGEYILYKKGRKQIKIRNSINEYKNTALRKLLVDEIKLILEKQRELNSSINDNFIKEYLEIFESQRSFDEGPGEPSPYGGNQIEKMLGNCTFEKEEKRAAKASYTFEYFKLLQDINHIKINKYDLETRKIEKRELTEEERQKIIKIVKEKANVTYSSLRKELNLSRTERFNMLSYKNILMWSDETNEEVEKTAKFKEFESYNKIKTALNRVEKGYIEKLTTEELDKIGYALTVYKNDDKRIAYLKENTQNLTEEAIQELLKLSFTKVGNLSIKAMKKIIPELEKGITYDKAVDNVYEDFRGIVNTEKKRKLRLQDLEQEISNPVVRRGISQAIKVLNAITLRYNEKYGKPDVVVIELSREMGKNFNDRSKIKKSQEENMQRNENIRQAIIELGKSNPTGQDIVKYKLWQEQDNFCVYSGKKITVDMLFTEAVDVDHIIPYSMCFDDTYNNKVLVLASENRQKGNRVPYKYEKEIGRNIDEYVVRVGNIIKNPKKLRRLLREDFTKEDAKDWKNRNIQDTQYMCKLMYNLVRNHLEFSDNKNFERKVWTVNGSVTAHIRKRLGIEKTRDGDTHHAVDAAVIAITTQNMINRITKYYQYNDGKYMNNKGEYIDLETGEILDAKEYEAKNGIYFPEPWPKFRKELDIRVNCNSKERMIECLNAEKIFTYEDYEDVEPIFVSRMPRRKVTGMAHLETIRGLREENGSLKTITKTELAKLKLDKSGEIEGYPEKNKKDDKLLYDALKEQLTKFGGDGKVAFKKDFYKPRADGNKGPIVRKVQIEANATLGVTLKDREGFAGNGDCVRLDIFYVEGEGYYFVPIYVSDTIKEKLPNKACVQGKKYEEWKEMREEDFIFSLYPKDLIYVKGKNKIKLNATNKSGEQIEVEDTMAYYINAGISVAQITIQTHDNKYEQPSLGIKSLKELKKYEVDVLGNYHEVKIPEKRMPFNIKK

SEQ ID NO: 1524 - protein, 1169 aa, unidentified
  REGION 1..1169: note = Description of Unknown: uncultivated organism with predicted taxonomy: Clostridiales
  REGION 1..1169: note = MG21-14 effector
MGYRIGLDLGISSIGWACVEDKENGEPKRIIDLGTRIFDRAENPKDGAPLAAPRREARELRRRLRRRNHRIKRTKILLEKYDIISQQEIEKMYENYNFPNTPYELRVIGLDNKLTNKELARVLISLVKKRGYKSNSKSEESNDKETGKLLTATKDNENLMKEKGYRSVAEMYLKDEKFKMRLPNGQIATRIDKNTGKEIEIIKIKNSINDYKNTPLRKLLVEEIKLILNKQKEYNPKITDQFINEYLNIFTSQRNFDEGPGEPSPYAGNQIEKMLGKCTFEREEYRAPKSTYTFEYFKLLQDLNHIKIIKYELKQDNEIVQTVRTLTEEERKKLIELAKKTPTLNYYKIRKEIKLKENERFNMCRYKSTREFTDDVNKEAENDNKKIKEFQSYHEIRKALDKYKKEYIQELSTNDLDSIGYALCVYKNDKKRIEYIKTNVTQIPDEVINYLLPLSFSKVGNLSLKAMKKIIPYLEKGLTYDKAVNELGKIDSNYSDFRGVVNTEKRRKLSINNLEDNISNPVVRRAVSQTIKVLNAITLKYNSIYGKPDLVVVELARELGKSFKERQSIEKIYEENRTRNEKAIQEIRELGKTNVTGKDIVKYKLWKDQNEICIYSGKHIKVEDLFTDAVDIDHIIPYSQCFDDTYKNKVLVLASENRQKGNRTAYKYIKEAGKNLEEYEVRVNNYIKDYRKKERLLKADFSTEDAKNWKDRNIEDTQYISRLVYKLINNYMEFSDNPNVNRKVRNINGAVTHYIRNRLGIEKIRADGDEHHAVDACIIATTSNYMVNKITRYSQYIDGRFMNDRGEYIDIETGEIINKEEYEEEYGPKFPEPWEGFRRELEIRSSDDVANRAEKTPEELKNIMIQEINDEIKNGKLYSYIEHDDGINRFDDIEPIFVSRMPRRKVKGQAHMETIRGIEKENGKLKTVTKTPLTKLKLDDNNEIKNYSKKAKQDDKLLYDALVEQLKKFNGKGEEAFKEPFFKPKKDGSKGPIVNTVKIEENATLGVEFKEGKAFAGNGNMVRIDVFYVEGEGYYFIPIYVADTIKKELPNKACVANKGTDKWKTMDDKNFIFSLYPNDLIYIESEKGIKLNGNNDNKKEQIEVKKLFAYYVKAGISTAAITIDNQDGEYTQPGLGIKGLKKIEKYDIDVLGNYHKIKLPEKRIKFNIN

SEQ ID NO: 1525 - protein, 1133 aa, unidentified
  REGION 1..1133: note = Description of Unknown: uncultivated organism
  REGION 1..1133: note = MG21-15 effector
MGYRIGLDIGITSVGWAVIEDDIEGKPKRIIDLGSRIFDAAENPKDGSALAKVRRDARGIRRRGRRKKHRIERTLHLLERHHIISKKEWISMFENYNFQFNIYELRVKALEEKITNKDLARILVNFVKKRGYKSNSKSEENDSSNDAGKLLTATKENQNIMQEKGYRTIGELYLKDDRFKLKDKNGDYILDKNGQKIMKVRNTTNDYKGTALRTLISDEIKLILNKQKEYTSLITDEFIQEYISIFESQRNFDEGPGEPSPYAGNQIEKMLGFCTFEKEERRAPKATYTFEYFKLLQDINHIKIEKLSLDDNMQRVKSKRSLVKDEKEKIIELVKSKTKISYYDIRKALNLQENERFNMFTYKNVLLWNNETNAEVEKDKIFKEFESYNKIKTALNRIEKNYILKLNTDELDYIGYALTVYKNDEKRISFLKENTSLPDRIINELLNLSFTKVGNLSLKSMKKIIPYLENGLTYDKAVNSVYEDFRGEINTEKKQKLRLKDLEEDISNPVVRRGISQAIKVLNAITLRYNAKYGKPDVVVIELAREMGRNFKDRNIIKKSQEINMKNNEFVKERIVELGKENPRGQDIVKYKLWQEQDGVCIYSGKKIPIENLFTEAVDVDHIIPYSMCFDDTYNNKVLVLASENRQKGNRVPYKYEKEIGRDIEEYEVRVNNIIKNPYKRVKLLREDFTREDALEWKDRNIQDTQYICKLMYNLVKNHLEFSNNKNFDRKVWTVNGAITSHIRKRLGIEKTRDGDIHHAIDAVVIAITTQEMINKLTKYYQYKDGKYMNNKGEFIDLETGEILDAEKYEKENGIYFPEPWPKFRKELEIRTICPTKETMISYLHNEKIFTYDDYEDVEPIFVSRMPKRKITGTAHLETVRGFEKRDNEIYTITKTELKKLKLDKDGEIEGYPEKNKRDDRLLYDALREQLKRYNNDGEKAFKDDFYKPRKDGSRGPLVKKVQIESKTTLGVELKNKGFAANGDSVRIDVFYIEGDGYYFIPIYVSDTIKKELPNRACVPNKTYSEWKEMDEKNFIFSLYPKDLLYIKGKNKIKLNPTNKIDEPIEVEETMAYYVKAGISVASITIQTHDNKYQQPNLGIKTLKKLKKYEVDVLGNYHEVKLPEKRMPFNIKK

SEQ ID NO: 1526 - protein, 1166 aa, unidentified
  REGION 1..1166: note = Description of Unknown: uncultivated organism
  REGION 1..1166: note = MG21-16 effector
MHYILGLDIGITSIGWAVIESDQDGVPFKIADLGVRIFKAAEQPKTGASLALPRRSARSLRRRLWRKAHRKERIKLLLDKVGLISKKNLEKLFSASSFEKDVYTLRAEGLDRKLNNEEWARVLYHLAQRRGYRSSSKAEEADKDNKEAGKLLNAVKSNSDKMKQNNFRTVGEMFCKDNSDLFQVKDGSGHIVGRKTHNTSGVYDLTIARNLIEAEVHKLFAAQRQLGNAFATESIENEYCEILLSQRHFSDGPGGERTFKFDLRGNCTFEKDELRAFKACYTFEYFKLLQDINHLRIIPEYRKGSAKQIRPLTPEERQKIIDLCLKSPGLDFSKLRKELKLEDDELFNRVSYDVKKKKGKKKDTEEQSEEQLTPEQQRLKCEKAAKFQQMQSYHEMRVALDKVAKGTISKLSHDQLDGIGEVLSLYKADDKRRERLEQIGLSNEEIEALLPLKFTKAGNLSLTAMRKLIPYLEQGLTYDKACEIVYSDHRAQYNGERMPLLSFGKLKEEGALDSVNNPVVLRAIAQTFKVVNAIIRRYSSPQAIHIELARDMKRNFTDRQDIKKKQDNNWSYNDRIRQKVEELKGSAATGQDIVKMKLYEEQNGVCLYSGKQLDIHRLFEVGYAEVDHIVPYSKCFDDSYNNKVLVFSSENQSKGNRLPLEYMLAEGDEDKLDNYVTLVEAFIKNTRKRQRLLKPCLTAEDSSDWKERNLTDTQYITKAVADILRNYLAFEEDSPFAKKPVRSINGAVTDQVRKRLGLQKHREEGDLHHAMDAAVIAVTTDGYINRISRYTQRREFGKRIGCYKDKQTGEKVEIEKQKGQAPLYVDPETGEKLTEQAFDQKYAPTFPAPWPEFTKELKARMAPNADEAIRQLYLPSYGSEEIKPIFVSQMPNRKVSGQAHAETIRSARVDVDESGKERIIAVAKTPLASLKLDKDGEIENYYMPSSDRLLYEELKNRLKAYDSAEQAFKEPVYKPKKDGNRGPRVYKVKTWKKTTSNVKVAGGIADNGSMVRIDVFYVKGEGYYFIPIYVADTIKKELPQKAVVDKSVAVKHGWKEMNDKDFIFSLYPGDLIRVEHKSQIVLKSTQKNSKDTKVGKEFFLYYKSANISNGAIDASYHDQSYEKEGLGIKTLQSFEKYEVDVLGNYHKVHLPEKRQAFNLKYSQKEQ

SEQ ID NO: 1527 - protein, 1100 aa, unidentified
  REGION 1..1100: note = Description of Unknown: uncultivated organism with predicted taxonomy: Clostridiales
  REGION 1..1100: note = MG21-17 effector
MSDFHYALGLDIGIGSVGWAVLRNQPNGEPDRIQDLGVRIFDKAEQPKTGASLAAPRRDARSARRRLRRHRHRLERIRYLMEQHDIMSVSDIQAMYTAGGFKKSPYQLRAEALDRPLSKEETVRVLIHLAQRRGYKSNSMAEAAKDEKETGKVKSAIEENRACMEQHGYRTVGEMMFRDERFWQNNPDGTRYHKTRNKVEDYRFTVERSDIVNEAKQIFAAQRQFGTGWLDDGMETAYLSILESQRSFDEGPGGDSPFRGGIGERVGSCTFEPDEQRAAKATYTFEYFKLLQDLNHMRLAGNGMAPRPLTAQQREILKAAALQSASLSYGQLRKKLALDDDVFFSGLCYGDKLKEEAEKRKWPQMQSYHKMRTALDKVGKGTIGTLTEFQLNAIASILTQYKSDARRIAALREAGIPMQFDEALLPLSFSKYGNLSVKAMQRLIPLLEQGMRYDEACTQIYGDHRGLHSEQRKSKLSLNDMEEITNPVVRRAVSQTIKVVNAVVRTYGPPDVVRIELAREMSQNFDDRRKAEKRQEENRAANERVKEQIAEYKGDRATGLDIVKFKLYREQDGVCLYSGKNLDIGRLFEPGYADVDHIIPYSRCFDDSYQNKVLVLASENRQKGNRLPYEYFGQDETRWHEYEVRVENLIRNYRKRQKLLKKQLTEEESTGFIDRNLKDTQYITRSIYNLLRDNLAFAESRYSKKPVQTVNGAVTSMLRSRWGVQKIREDGDLHHCMDAAVIAATSPGLVQRLTEYSKRREALEEAPRGYVDPSTGELVEQSEQPRRDPFPKPWEQFHQELEARLATVDPRHQIDLLKLATYESDEEVKPVFVSRMPNHKVTGAAHAETIRSSKGGDGYTVTKTPLISLKLNKSGEIDGYYNWSSDKLLYDALLARLKEFGGDGAKAFAEPFYKPKRDGTPGPRVDKVKICERATTGLPVRDGIAANGSMVRIDVFYVEDEGYYFVPIYVADTKKECLPNKAVVAYKAYSDWKEMTDENFIFSLYPGDLVRIQSRKGIKLNIAKGGTGEKEIVRQDGMYYYQTANISSGAITISTHDRRYSQPSLGIKTLQSIEKYQVDVLGNYYKVDLPEKRMSFSEEG

SEQ ID NO: 1528 - protein, 1007 aa, unidentified
  REGION 1..1007: note = Description of Unknown: uncultivated organism with predicted taxonomy: Clostridiales bacterium 42_27
  REGION 1..1007: note = MG21-18 effector
AMFAAGGFKKSPYRLRAEALDRLLSKEETVRVLIHLAQRRGYKSNSMAEAAKDEKETGKVKSAVEENRACMEQHGYRTVGEMMFRDERFWQSNPDGTRYHQTRNEAEDYRFTVERSDIVNEAKQIFAAQRQFRADWMDDGMEAAYLSILESQRSFDEGPGGDSPFRGGIGEKVGFCTFEPEEHRAAKATYTFEYFKLLQDLNHMRLAGSGTAPQPLNAQQREILKAAALQSASLSYGQLRKKLALDDDVFFNGLYYGDKPREEAEKRKWPQMQSYHKIRTALNKAGKGTIRSLTEEQLNAITSILTQYKSDARRIEKLREAGIPELFDNALLPLSFSKYGNLSVKAMQRLIPLLEQGMRYDEACTQIYVDHRGLHPEQRKNRLSLNDMEEIINPVVRRAVSQTIKVVNAVVRTYGPPDVVRIELAREMSRNFDDRRKAEKRQEENRAANERAKEQIVEYKGDCATGLDIVKFKLYREQDGVCLYSGQNLDLSRLFEPGYVDVDHIIPYSRCFDDSYQNKTLVLASENRQKGNRLPYEYFGQDEARWHEYEVRVENLIRNYRKRQRLLKKRLTEDESAGFIDRNLKDTQYITRSIYNLLRDNLAFAESRYSKKPVQTVNGAVTSMLRSRWGVQKIREDGDLHHCMDAAVIAATSPGLVQRLTEYSKQREAFVKAPAGYVDPSTGGLVEQSEASRRDPFPKPWEQFHQELEARLDPIDPQHQIDLLKLATYESDEEVKPVFVSRMPNHKVTGAAHAETIRSSKGGDGYTVTKTPLANLKLNKLGEIDGYYNPGSDKLLYDALLARLKEFGGDGAKAFAEPFYKPKRDGTPGPRVDKVKICEKATTGLPVRDGIAANGSMVRIDVFYVEDEGYYFVPIYVADTKKESLPNKAVVAYKAYSDWKEMIDENFIFSLYPGDLVRIQSRKGIKLNIAKGGTGEKEVVRQDGMYYYRAAGITVGAIQIETHDRRYLQPSLGLKTLQSIEKYQVDVLGNYYKVDLPEKRMKFSKEG

SEQ ID NO: 1529 - protein, 1193 aa, unidentified
  REGION 1..1193: note = Description of Unknown: uncultivated organism
  REGION 1..1193: note = MG21-19 effector
MQQKMEKPEMPYVLGLCLSTTSVGWSVLETDETGIPFRIADLGVRTFQEAKTNYKRSKCRTSRRRLQRKSCIKSRVSELFERSGLITKEALEEIFVKSGFEKDIIVLRKDGLDRKLENDEWARVLYNFTQRRGYKVVSAAREISAKKIAEESKKQNSKSNLSNEDKVAQEEAKRHAGLLAAVNNNTKELKKDNYRTIGEMFCSSKDERFMVKDGSNREIGRTTRNKHGIYSFAVSRELIKDEISKLFDAQRKQGNKFADKSFQKEYENIVFSHNDKSQDLRGNCFFEKGEKCAFKGGYTFEYFKLLCELNNIRIISTESKVDEAVRKITESQRNTIIGLYKKSPKLTPKDLSKKLNLKSSEYLRSFNTKQMQSYHEIREALNKVTKNIANDLSNEQFDEIGEILSLYKNDDERREKLQELRINVGLGNNGLGDAEIKSLLELNFSGTGSLSLKAMKNLIPYLEKGLSYGEACEKVYGDHRTQCGGERMEYLSFKKLKEEGALDSINSPVVARATTQAFKVINAVICKYGSPQSVHIELSRDIKCGSRTRERIAQENEANRERREKLINEVENIKKQKHCEKVNATEQEILKLQLYKDQHGKCLYSGKELDKDKVISESGYAEIDHIIPYSQSFDNSEANKVLTLSEENRNKGNDVPVAYILRKHKNSEKEYDAFVKRVKSVTKEVSNTNKDRQKILEKRKQNLLISPNFKVDELEGLLVRETVGVQNIQKRIADILRNYLRFYGEMPMEQHIVVTKNSITEAICEQLGLQRYYTKVSALSSALNAILIAVTPANYEAKVTQYVQSREEHYTDDGYIDPENGKKLTIEEFDAKYMPESDLKCIYSYLKEEIEIWMSSASDKKSINAKRGKLEKLHKKLGLKGKYENEINNWKPIFVSQMPDRKISGQAHAETIRSARIDIDENGKERIIAVAKTPLTSLKLDKNGEIDGYYMPSSDRLLYEELKNRLIKTKTSGKTYGNAEQAFKEPVYKPKKDGSQGPRVYKVKTWKPTTSNVKVAGGIAKKGDIVRVDIFHITGGKDQGYYFVPIYVADTIKNTLPKHAVVTNFKSSKVEWKEMDDSNFIFSLYKGDLIHIELCADCRDKDSNNKIRKAKDMYVYYDGVDFYQSGKCTNQSIGELNGAINVSWHDGSCEDSIHIKEINVLEKYEVDVLGNYHKVRLPERRQAFNLKYSQKEQ

SEQ ID NO: 1530 - protein, 1100 aa, unidentified; identical to SEQ ID NO: 1527
  REGION 1..1100: note = Description of Unknown: uncultivated organism with predicted taxonomy: Clostridiales
  REGION 1..1100: note = MG21-20 effector

SEQ ID NO: 1531 - protein, 808 aa, unidentified
  REGION 1..808: note = Description of Unknown: uncultivated organism with predicted taxonomy: Clostridiales bacterium 42_27
  REGION 1..808: note = MG21-21 effector
VERTKRLLERYDIITKKEVEAMYANQAHVKHLYNVYELRVLGIEQKLTNKELARVLISLVKKRGYKSNSKAEESNGEAGKLLTATRDNELLMQSKGYRTVAEMYLKDDKFKAKDKNGEILVDKDGSPLLKIKNSTGDYKNTTLRKLLVEEIKLILNKQKELNSKITDDFINEYLKIFESQRNFDDGPGFPSPYGGNLIENMLGNCTFEKEEKRAPKATYTFEYFKFLQTLNHIKIETINKKDDGTINKEKRELTSEEKEKLKELVFSKVTVTYSDVRKTLQLESNQRFNMFTYRDLLNYTEETNKEIEREKKLKEFESYKKIKTTLNHIEKNYITKLTTDELDEIGYALTVYKNDDKRKEYLENHTTNLSKEAIEELLKLSFSKVGNLSLKAMKKIIPELEKGVTYDKAVDKVYEDFRGTVDTQKKRKLSIKDFEQEISNPVVRRGLSQAIKVLNAITLRYNEKFGKPDVVVVELARELGKNFADRKAIEKRQNDNMQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNNKKKQNLLRQDFTREDAEDWKERNLNDTKYICKYMYNLIRNHLEFSDNPNFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLEAEKVYTYEDYDDVEPIFVSRMPRRKVTGTAH

SEQ ID NO: 1532 - protein, 769 aa, unidentified
  REGION 1..769: note = Description of Unknown: uncultivated organism with predicted taxonomy: Clostridiales
  REGION 1..769: note = MG21-22 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMDEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQCLTAYNKHRETWERPPAG

SEQ ID NO: 1533 - protein, 861 aa, unidentified
  REGION 1..861: note = Description of Unknown: uncultivated organism with predicted taxonomy: Roseburia inulinivorans
  REGION 1..861: note = MG21-23 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVAD

SEQ ID NO: 1534 - protein, 1107 aa, unidentified
  REGION 1..1107: note = Description of Unknown: uncultivated organism with predicted taxonomy: Firmicutes
  REGION 1..1107: note = MG21-24 effector
MKKRKKKKKDKKDCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSIFFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAEENRQKGNRTPYEYFGADEQRWHEFSARVRASVRDFKKRQKLLNTSFGEEQKNEFTQRNLNDTQHITRVVYNYLRNNLEFADSAYAKAPVQAVNGAVTAMLRGRWGIEKMRGDGDLHHCKDAVVIAATSRSMIEDLTKYYQEEEQRFMGKTHFVDPATGEVLTRKEFPQPWPRFREELEARLDPIDPMEAVMALHLSTYEPEEEIAPVFVSHMPKHTVTGAAHEETIRSRTETGTVVKTALTSLKLDKNGGIEGYYNPQTDPRLYQALVERLRQFDGKGEKAFAEPFYKPKKDGTPGPRVDKVKIERKSSLSVSTGRGVADNGRMVRIDVFRVPDDGYYFVPIYVADTKKAVLPSKAVVAGKSPEAWKQMKPERFLFSLFKDDLIYVESRKGISLALAKEAVGEKTIQPKSGLFYFCGANISSGSIGIETDDRRYGKESLGLKTLTLIEKCQVDVLGNVSKVRLPEKRLEFRGRK

SEQ ID NO: 1535 - protein, 1058 aa, unidentified
  REGION 1..1058: note = Description of Unknown: uncultivated organism with predicted taxonomy: Clostridiales bacterium 42_27
  REGION 1..1058: note = MG21-25 effector
KAEQPKTGASLAAPRRDARSARRRLRRHRHRLERIHYLMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGVVWMDEDMETAYLSVLESQRRFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARHDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1536 - protein, 1100 aa, unidentified
  REGION 1..1100: note = Description of Unknown: uncultivated organism with predicted taxonomy: Ruminococcaceae bacterium TF06-43
  REGION 1..1100: note = MG21-26 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTVIEENRRCMAEYGYRTVGEMMYRDERFWQKHPDGTRYHQTRNKAEDYRFTVERAAIVDEVRQIFAAQRKLGVVWMDEDMETTYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIATTTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGTKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1537 - protein, 1098 aa, unidentified
  REGION 1..1098: note = Description of Unknown: uncultivated organism with predicted taxonomy: Clostridiales
  REGION 1..1098: note = MG21-27 effector
LSLRYTLGLDIGIASVGWAVLENNIDGEPIKIERLGVRIFDKAEHPKTGASLAEPRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLHDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIEKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKTLTSLSLNKKTGEIEGYYAPESDRLLYEALKKRLEEFDGNAKEAFAEPFYKPKRDGTRGPLVKKVKIYEKKTITVPVNGGNADNGSMIRVDVFYMEDDGYYYVPIYTADVIKGKLPNKAVVQGKTFEDWKEMDDRDFLFSMYPSDLLYIESRRGIKLKTKKGSSWQEEIARKAGLYYFKGLNISSGNLFIITHDHSYEQSSLGGKTLSCLKKYTVDALGNYSEVSLPEKRKPLRG

SEQ ID NO: 1538 - protein, 1100 aa, unidentified
  REGION 1..1100: note = Description of Unknown: uncultivated organism with predicted taxonomy: Clostridiales bacterium 42_27
  REGION 1..1100: note = MG21-28 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1539 - protein, 1100 aa, unidentified
  REGION 1..1100: note = Description of Unknown: uncultivated organism with predicted taxonomy: Firmicutes
  REGION 1..1100: note = MG21-29 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGQSPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEIANPVVRRAVSQTIKVINAVVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGNDDVRWHEYEVRVENLIRNYRKRQKLLKRQLSEEESAGFIDRNLKDTQYITRAIYTLIRDNLVFAESNYKKRPVQTVNGAVTSMLRNRWGVQKIREDGDLHHCLDAAVIAATTPGLVQRLTEHSKRRETLEKAPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1540 - protein, 836 aa, unidentified
  REGION 1..836: note = Description of Unknown: uncultivated organism with predicted taxonomy: Clostridiales bacterium 42_27
  REGION 1..836: note = MG21-30 effector
RVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAAVAMKPYNLWKKMKDENFVFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1541 - protein, 1103 aa, unidentified
  REGION 1..1103: note = Description of Unknown: uncultivated organism
  REGION 1..1103: note = MG21-31 effector
MKKGQKHCHYTLGLDIGIASIGWAVLGNDEDGTPNRIIDLGVRIFDKAEVENTGESLAAPRRDARSARRRLRRHRHRLERIRYLLVQQGVLTQEEMTHLYDKSDMVSPYQLRTEGLDRLLNAREFSKVLIHLAQRRGYQSNSTAEEVKNEKENGIIKSAILENQQRMEQGGYRTIGEMMYRDAAFWETINGIRYHCTRNKAGDYRFTVDRASILAEVSIFFEAQRRLGSPWASVEMEDAYTGILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMHHSIKERNRMKKRQEENREKNEQVKAQILETKPGTRVTGLDIVKFKLYQEQDGICLYSGKPLEIERLYEPGYAEVDHIIPYSRCFDDSYSNKVLVLAEENQQKGNCTPYEYFGADEQRWHEFSVRVGASVRDFKKRQKLLNTSFGEEQGKDFIQRNLNDTQHITRVVYNYLRNNLEFADSAYAKAPVQAVNGAVTAMLRGRWGIEKMRGNGDLHHCKDAVVIAATSDSMIKDLTKYYQEEEQRFMGKTHFVDPATGEVLTRKEFPQPWPRFREELEARLDPTNPKEALMALNLSTYEFDPEEEIPPVFVSHMPKHTVTGAAHEETIRGKTETGTVVKTALTSLKLDKNGEIEGYYNPQTDPRLYQALVERLRQFDGKGEKAFAEPFYKPKKDGTPGPRVDKVKIERKSSLSVSTGRGVAKNGDMIRMDVFRIPNERKPDDSYYFVPIYVADTKKRILPSRAVVRGKLPEEWKQMKPEHFLFSLFKGDLIYVESKKEISLALAKEAVGEKTIQVKSGLFYFCGANISNGSIEIETHDRRYGKEGLGIKKLKVFEKRQVEVLGEVRKVKLPEKRLEFRGRK

SEQ ID NO: 1542 - protein, 1100 aa, unidentified
  REGION 1..1100: note = Description of Unknown: uncultivated organism with predicted taxonomy: Ruminococcaceae bacterium TF06-43
  REGION 1..1100: note = MG21-32 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVQVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPASYVDPATGDLLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKKERLPNKAVVAYKAYSEWKEMKDENFIFSLYPGDLVRIQSRKGIKLTLTKGGTGEPEIVRQQGMYYYQTANISSGAVTISTHDRRYSQSSLGIKTLQSIEKYQVDVLGNYYKVDLPEKRMTFSKEG

SEQ ID NO: 1543 - protein, 1097 aa, unidentified
  REGION 1..1097: note = Description of Unknown: uncultivated organism with predicted taxonomy: Clostridiales
  REGION 1..1097: note = MG21-33 effector
LSLRYTLGLDIGIASVGWAVLENNIDGEPIKIERLGVRIFDKAEQPKTGASLAEPRREARGQRRTIRRRRHRKDRIKQLIQQNDIMTRVEMAEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLGLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPSMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATLHRKADGGYINKVSLTKLTLDKKTGEIKNYYAPESDRLLYEALKKRLKEFDGNAKEAFAEPFYKPKRDGTRGPLVKKVKLYEKKTITVPVGGGNADNGSMIRVDVFYIEDDGYYYVPIYTADVIKGALPNRAVVADKSHGEWKVMNDKDFLFSMYPNDLLYIESRKGIKLKTKKGSSKQEQIVRKTGLYYFKGLNISSNALSIITHDHSYEQSSLGGKTLSCLKKYTVDALGNYSEVSLPEKRKPLRG

SEQ ID NO: 1544 - protein, 1100 aa, unidentified
  REGION 1..1100: note = Description of Unknown: uncultivated organism with predicted taxonomy: Clostridiales
  REGION 1..1100: note = MG21-34 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1545 - protein, 1100 aa, unidentified
  REGION 1..1100: note = Description of Unknown: uncultivated organism with predicted taxonomy: Clostridiales
  REGION 1..1100: note = MG21-35 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKNQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1546 - protein, 1127 aa, unidentified
  REGION 1..1127: note = Description of Unknown: uncultivated organism
  REGION 1..1127: note = MG21-36 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNKIPYQYMQEKGRDLDEYEIRVNNIIKNYSKKQRLLKQKFTREDANEWKDRNIQDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKPYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1547 - protein, 1100 aa, unidentified
  REGION 1..1100: note = Description of Unknown: uncultivated organism with predicted taxonomy: Clostridiales
  REGION 1..1100: note = MG21-37 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1548 - protein, 1100 aa, unidentified
  REGION 1..1100: note = Description of Unknown: uncultivated organism with predicted taxonomy: Clostridiales bacterium 42_27
  REGION 1..1100: note = MG21-38 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFFGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1549 - protein, 1100 aa, unidentified
  REGION 1..1100: note = Description of Unknown: uncultivated organism with predicted taxonomy: Clostridiales
  REGION 1..1100: note = MG21-39 effector
MSEFHYALGLDIGIGSVGWAVLRNQTNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLNPIDPRHQIDLLKLSTYESDEEIKPVFVSRMPNHKVTGAAHAETIRSRKGGDGFTVTKTPLTNLKLNKFGEIEGYYNPASDTLLYNALLSRLKDFGGDGAKAFAKPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1550 - protein, 1100 aa, unidentified
  REGION 1..1100: note = Description of Unknown: uncultivated organism with predicted taxonomy: Clostridiales
  REGION 1..1100: note = MG21-40 effector
MSDFHYALGLDIGIGSVGWAVLRNRPDGEPDRIQDLGVRIFDKAEQPKTGASLAAPRREARSARRRLRRHRHRLERIRYLMEQHGIMPISDIQAMYAAGGFEKSPYQLRAEALDRPLSREELVRVLIHLAQRRGYRSNSTAEAAKNEKETGKVKSAIEENRACMEQHGYRTVGEMMFRDERFWQNNPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEKRRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDEARWHGYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPQHQIDLLKLATYESDEEIRPVFVSRMPNHKVTGAAHAETIRSSKGGDGFTVTKTPLANLKLNKFGEIEGYYNPASDTLLYNALLARLKDFGGDGAKAFAQPFYKPKKDGTPGPRVDKVKICEKATIGLPVRNGIAANGSMIRIDVFYVEDDGYYFVPIYVADTKKAELPNKAVVAYKAYSDWKEMIDENFLFSLYPGDLVRIQSRKGIKLNIAKGGTGEKEIVRQDGLYYYQGANIATGAIALATHDRRYLQSGLGLKTLQSIEKYQVDVLGNYYKVDLPEKRMKFSKEG

SEQ ID NO: 1551 - protein, 1102 aa, unidentified
  REGION 1..1102: note = Description of Unknown: uncultivated organism with predicted taxonomy: Firmicutes
  REGION 1..1102: note = MG21-41 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDTVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILAEVSILFEAQRRLGAPWASVEMEDAYTAILSGQRSFDEGPGGDSPFRKGISDRVGYCTLEPTEQRAAKADATFEYFKLLQDLNHMRLVDNSGSHPLTQQQRALLEEMAFRSANLTYGQLRKKLGLLDEVRFAGLYYGEDTIEKAEKRKWAQMQSYHKIRTALDKVSKDAISMFDKDQLDAIGEILTAYKADAARIEHLQTAGIQKEYHKALLSLSFSKYGKLSCCAMRKLIPFLQQGMRYDEACREVYQDHRTKEASEKKQRLSLNDIDEITNPVVRRAVSQTIKVVNAVVRTYGNPDAVRIELAREMSHSFDERNKMKKRQEDGWQKNEQVKAQILETKTGTRVTGLDIVKFKLYQEQDGICLYSGTPMEIERLYEPGYADVDHIIPYSRCFDDSYSNKVLVLASENRQKGNRTPYEYFGANEQRWHEFSVRVGASVRDFKKRQKLLNTSFGEEQGKEFIQRNLNDTQHITRVVYNYLRNNLEFADSAYAKAPVQAVNGAVTAMLRGRWGIEKMRGDGDLHHCKDAVVIAATSRSMVQRLTNYYKEEERLFMGKTHFVDPATGEVLTRKEFQQRFAPKFPQPWDRFREELEARLDPIDPMEAVMALHLSTYEPEEEIAPVFVSHMPKHTVTGAAHEETIRSRTETGTVVKTALTSLKLDKNGEIEGYYNPQTDPRLYQALVERLKKFGGDGAKAFAEPFYKPKKDGTPGPRVDKVKIERKSSLSVSTGRGVADNGRMVRIDVFRIPDDGYYFVPIYVADTKKATLPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1552 - protein, 818 aa, unidentified
  REGION 1..818: note = Description of Unknown: uncultivated organism with predicted taxonomy: Clostridiales
  REGION 1..818: note = MG21-42 effector
EKRELTSEEKEKLKELVFSKVTVTYSDVRKTLQLESNQRFNMFTYRDLLNYTEETNKEIEKEKKLKEFESYKKIKTALNHIEKNYITKLTTDDLDEIGYALTVYKSNDKRKEYLEKHTPNLSKEAIEELLKLSFSKVGNLSLKAMKKIIPELEKEVTYDKAVDKVYEDFRGTVDTQKKRKLSLKDFEQEISNPVVRRGLSQAIKVLNAITLRYNEKFGKPDVVVVELARELGKNFADRRTIEKRQSDNTQTNEKAKESIIALGKNNPTGKDIVKFKLWQDQDCKCIYSGKTIPVEELFTDLVDVDHIIPYSQCFDDSYNNKVLVLASENRQKGNRVPYKYLKESGKNLEEYEIRVNTLIRNSKKKQNLLRQDFTREDAEDWKERNLNDTKYICKYMYNLIRNHLEFSDNANFVRKVWTVNGALTAHIRKRLGIEKVRDGDTHHAVDATVIAITTQGMVNKLTKYYQYVDGRYMNNKGEYIDTYTGEIINAKEYEEKYGIYFPEPWPKFRKELDIRTNCKTRERMIECLESEKIYTYEDYDDVEPIFVSRMPRRKVTGPAHVATIRGIKEKDGELKTITKTELTKLKLKDGEIEGYPENCRRDDRLLYEALKNRLIEFNGDAVKAFSEPFYKPKSDGTRGPIVNKVKIEANTTMGVTLNDKKAFAANGDCVRLDIFYVENEGYYFIPIYVSDTVKKELPNKACVSGKKYADWKEMKDENFIFSIYPKDLIYIQGKNKIKLNPVIKDKDSIEVEDIFAYYIKAGISSAVITIQTNEGKYVQPSLGIKSLKKLEKYEVDILGNYHKVKLPEKRLPFNINKK

SEQ ID NO: 1553 - protein, 843 aa, unidentified
  REGION 1..843: note = Description of Unknown: uncultivated organism with predicted taxonomy: Clostridiales bacterium 42_27
  REGION 1..843: note = MG21-43 effector
FSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANKRAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHPCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRGSDISTGAISVSSHDRRYESRGIGVKTLQSIEKYQVDVLGNYYKVDLPEKRMTFSKEG

SEQ ID NO: 1554 - protein, 1128 aa, unidentified
  REGION 1..1128: note = Description of Unknown: uncultivated organism with predicted taxonomy: Clostridiales
  REGION 1..1128: note = MG21-44 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLLKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1555 - protein, 1100 aa, unidentified
  REGION 1..1100: note = Description of Unknown: uncultivated organism with predicted taxonomy: Clostridiales
  REGION 1..1100: note = MG21-45 effector
MSEFHYALGLDIGIGSVGWAVLRNQPYGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1556 - protein, 818 aa, unidentified; identical to SEQ ID NO: 1552
  REGION 1..818: note = Description of Unknown: uncultivated organism with predicted taxonomy: Clostridiales
  REGION 1..818: note = MG21-46 effector

SEQ ID NO: 1557 - protein, 1098 aa, unidentified; identical to SEQ ID NO: 1537
  REGION 1..1098: note = Description of Unknown: uncultivated organism with predicted taxonomy: Clostridiales
  REGION 1..1098: note = MG21-47 effector

SEQ ID NO: 1558 - protein, 848 aa, unidentified
  REGION 1..848: note = Description of Unknown: uncultivated organism with predicted taxonomy: Clostridiales bacterium 42_27
  REGION 1..848: note = MG21-48 effector
LMEQRGIMPVADIQAMYAAGGFQKSPYQLRAEALDRPLIKEEAVRVLIHLAQRRGYKSNSTAEAAKDEKETGKVKTAIEENRRCMAEHGYRTVGEMMFRDERVWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDK

SEQ ID NO: 1559 - protein, 1100 aa, unidentified
  REGION 1..1100: note = Description of Unknown: uncultivated organism with predicted taxonomy: Clostridiales bacterium 42_27
  REGION 1..1100: note = MG21-49 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1560 - protein, 1100 aa, unidentified; identical to SEQ ID NO: 1538
  REGION 1..1100: note = Description of Unknown: uncultivated organism with predicted taxonomy: Clostridiales bacterium 42_27
  REGION 1..1100: note = MG21-50 effector

SEQ ID NO: 1561 - protein, 983 aa, unidentified
  REGION 1..983: note = Description of Unknown: uncultivated organism with predicted taxonomy: Clostridiales bacterium 42_27
  REGION 1..983: note = MG21-51 effector
MSEFHYALGLDIGIGSVGWAVLRNQPNGEPDRIQDLGVRIFDKAEQPKTGASLAAPRRDARSARRRLRRHRHRLERIRYLMEQRGIMSVSDIQAMYAAGGFQKSPYQLRAEALDRPLSKEEAVRVLIHLAQRRGYKSNSTAEAAKDEKETGKVKTAIEENHRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDDEQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDVACTRVYGDHRGLRPGQRTNRLSLKDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIREHLVFAESAYRKKPVQTVNGAVTSMLRGRWGVQKIREDGDLHHCLDAAVIAATTPGLVQRLTAYNKRRESWERSPAGYVDPATGELIVLPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAA

SEQ ID NO: 1562 - protein, 1026 aa, unidentified
  REGION 1..1026: note = Description of Unknown: uncultivated organism with predicted taxonomy: Clostridiales bacterium 42_27
  REGION 1..1026: note = MG21-52 effector
ERIRYLMEQRGIMPVADIQAMYAAGGFQKSPYQLRAEALDRPLTKEEAVRVLIHLAQRRGYKSNSTAETAKDEKETGKVKTAIEENRRCMAEHSYRTVGEMMYRDERFWQKHPDGTRYHQTRNKAEDYRFTVERAAIVDEARQIFAAQRRLGTVWMDEDMETAYLSILESQRSFDEGPGGDSPFSGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIQPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGNMVRIDVFYVEDDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1563 - protein, 1097 aa, unidentified
  REGION 1..1097: note = Description of Unknown: uncultivated organism with predicted taxonomy: Clostridiales
  REGION 1..1097: note = MG21-53 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERTLTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYATAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSAKSLRKLIPYLEKGMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQEQKGVCLYSGQNLDITRLFEAGYVDVDHIVPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVSRKPERKTTGAAHEATIRSAKKPGGSISKKPLTSLSLNKKTGEIEKYYAPESDRLLYEALKKRLEEFDGNAKEAFAKPFYKPKRDGTRGPLVKKVKLYEKKTITVPVNGGNADNGRMIRVDVFYMEDDGYYYVPIYITDVVKDELPNKAVVQKKLPEDWKEMDDRDFLFSMYPNDLIYVERKEVFELTAPKGSSLDPTISKTKGFFYYRSFDSNTGSFKIYTHDSSYSKKSLGGKTLSCLKKYTVDVLGNYSEVSLPEKRKPLRG

SEQ ID NO: 1564 - protein, 1100 aa, unidentified
  REGION 1..1100: note = Description of Unknown: uncultivated organism with predicted taxonomy: Clostridiales
  REGION 1..1100: note = MG21-54 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDHPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMEIAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTEYKSDAKRIAALREAGIPPQFDEALLPLSFSKYGSLSVRAMQKLIPLLEEGLRYDGACTRVYGDHRGLRPGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRDHLAFAESAYRKKPVQAVNGAVTAMLRGRWGVQKIREDGDLHHCLDAAVIAATTPGLVQRLTAYNKHRETWERPPAGYVDPVTGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRNGIAANGSMVRIDIFYVEDDGYYFVPIYVADTKKDRLPSKAPVAHKAYSAWKEMRNENFIFSLYPGDLVRIQSRAGIKLSLAKDGTGEKEIVRQNGLYYYRSADIEGGKIDIEAHDRRYSKHGLGLKTLQSIEKYQVDVLGNYYKVDLPEKRMTFSKEG

SEQ ID NO: 1565 - protein, 986 aa, unidentified
  REGION 1..986: note = Description of Unknown: uncultivated organism with predicted taxonomy: Ruminococcaceae bacterium TF06-43
  REGION 1..986: note = MG21-55 effector
LLNAREFSKVLIHLAQRRGYQSNSTAEEAKNEKENGIIKSAILENQQRMEQGGYRTIGEMMYRDAAFWETINGIRYHCTRNKAGDYRFTVDRASILSEVSLLFEAQRRLGSPWASVEMEDAYTAILASQRSFDEGPGNDSHGNESPFRKAMSHNVGNCTLIPTEPRAARADYTAEYFKLLQDLNHMRLVDNSGSHPLTQQQRAILEEMAFRSANLTYGQLRKKLGISDEVRFAGLYYGQDTIEKAEKRKWPQMQSYHKIRTALDKVSKDAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVREYGNPDAVRIELAREMHHSIKERNRMKKRQEENREKNEQVKAQILETKPGTRVTGLDIVKFKLYQEQDGICLYSGKPMEIERLYEPGYAEVDHIIPYSRCFDDSYSNKVLVLAKENQQKGNCTPYEYFGADEQRWHEFSARVRASVRDFKKRQKLLNTSFGEEQGKEFIQRNLNDTQHITRVVYNFLRNNLEFADSAYAKAPVQAVNGAVTAMLRGRWGIEKMRGNGDLHHCKDAVVIAATSDSMIEDLTDYYKEEERLFMGKTHFVDPATGEALTRKEFQQRFAPQFPQPWPRFREELEARLDPIDPMEAVMALHLSTYEPDEEIAPVFVSHMPKHTVTGAAHEETIRGKTETGTVVKTALTSLKLDKNGEIDGYYNPQTDPRLYQALVERLKKFGGDGARAFAEPFYKPKKDGTPGPRVDKVKIKSKSSLSVPTGRGVAKNGDMIRMDVFHVPDDGYYFVPIYVADTKKAILPSKAVVAGKSPEAWKQMKPEHFLFSVFKGDLIYVESKTEISLALAKNAVGEKTIQVKSDLFYFCGADISNGSIKIKTHDRRYEQKKLGIKKLEVLEKYQVDVLGNVSKVKLPETRLEFRGRK

SEQ ID NO: 1566 - protein, 1046 aa, unidentified
  REGION 1..1046: note = Description of Unknown: uncultivated organism with predicted taxonomy: Clostridiales bacterium 42_27
  REGION 1..1046: note = MG21-56 effector
PPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDPLTAETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1567 - protein, 1098 aa, unidentified
  REGION 1..1098: note = Description of Unknown: uncultivated organism
  REGION 1..1098: note = MG21-57 effector
MTSQAIRYTLGLDIGIASVGWAVLKNGSDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNKQVMKAHGYRTFGEMLLMDDRFYYTQPDGARIFIPHNKASDYKVTAERGMLADELHMIFAAQRSLGSLWFSDTFETAYMEVWSSQRSFDEGPGGNSQYGGNQIEKMLGKCFDGELRAPKASYSAEYFRLLQDINHLRIVSLDGASSPLTQEQRDIVVAASKKSGTLTYTQLRKKLALADDQYFNALYYGDKTTAEIEKKKFGHLQFYHQLRTVLDKVEKGAADTLTWEQRDEIARILTVYKADDRRTDELQKAGIPEKYIDALLPLSPTKAMHLSITAIKKIIPYLEAGMPYSDALSKAYGNQTNASTSSKKHKLSLSDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLNIARLFEPGYVDIDHIIPYSISFDDSYNNKVLVLSSENRQKGNRIPYAYFGQNSDRWEKYETLVNNTVRSYRKRKNLLLKSLSEAQIDGFKQRNLQDTQYLSKVVFRLIEDHLQFAETAPGKKHTQPVNGAITAQVRKRLGIEKIREDGDLHHAMDAAVIACITPGMIQRITKYAQNHERFYATAKGYADIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRFNRRGLGGKTLLSIEKYQVDVLGNYFPVALPEKRMKFR

SEQ ID NO: 1568 - protein, 1100 aa, unidentified
  REGION 1..1100: note = Description of Unknown: uncultivated organism with predicted taxonomy: Oscillibacter sp. CAG:241_62_21
  REGION 1..1100: note = MG21-58 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPEKRMTFSEEG

SEQ ID NO: 1569 - protein, 1100 aa, unidentified
  REGION 1..1100: note = Description of Unknown: uncultivated organism with predicted taxonomy: Clostridiales
  REGION 1..1100: note = MG21-59 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQSSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1570 - protein, 1100 aa, unidentified; identical to SEQ ID NO: 1538
  REGION 1..1100: note = Description of Unknown: uncultivated organism with predicted taxonomy: Firmicutes
  REGION 1..1100: note = MG21-60 effector

SEQ ID NO: 1571 - protein, 1100 aa, unidentified; identical to SEQ ID NO: 1544
  REGION 1..1100: note = Description of Unknown: uncultivated organism with predicted taxonomy: Clostridiales
  REGION 1..1100: note = MG21-61 effector

SEQ ID NO: 1572 - protein, 1100 aa, unidentified
  REGION 1..1100: note = Description of Unknown: uncultivated organism with predicted taxonomy: Firmicutes bacterium CAG:129
  REGION 1..1100: note = MG21-62 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLIKEEAVRVLIHLAQRRGYKSNSTAEAAKDEKETGKVKTAIEENRRCMAEYGYRTVGEMMYRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALMEAGIPPQFDEALLPLSFSKYGSLSVRAMQKLIPLLEEGLRYDEACTRVYGDHRGLRSEQRTNRLSLNDMEEITNPVVRRAVSQTIKVINAVVRTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERPPAGYVDPATGELIELPQEARHDQFPKPWERFRQELEARLDPIDPRHQIDLLKLETYESDEEIQPVFVSRMPNHKVTGAAHAETIRSSKGGDGFTVTKTPLTNLKLNKFGEIEGYYNPESDKLLYDALLARLKAFGGDGAKAFDQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1573 - protein, 1100 aa, unidentified
  REGION 1..1100: note = Description of Unknown: uncultivated organism with predicted taxonomy: Clostridiales
  REGION 1..1100: note = MG21-63 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLELETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1574 - protein, 1100 aa, unidentified
  REGION 1..1100: note = Description of Unknown: uncultivated organism with predicted taxonomy: Clostridiales
  REGION 1..1100: note = MG21-64 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1575 - protein, 833 aa, unidentified
  REGION 1..833: note = Description of Unknown: uncultivated organism with predicted taxonomy: Clostridiales bacterium 42_27
  REGION 1..833: note = MG21-65 effector
LSLRYTLGLDIGIASVGWAVLENNIDGEPIKIERLGVRIFDKAEETDGSPLAKHRREARGQRRTIRRKRHRKDRIKQLIQQNGIMTRVEMSEMFEHSQFETSVYELRVQALERALTKQEFVRVLIHLAQRRGYKSNSKSEEAKDKENGKVKSAISENKQCMEENGYRTIGEMLLNDDRFWECNPDGTKIFVPHNHLDDYRTTVERSMVEDEIRLIFSQQRALGVSYVTAEFEEAYLEIWGSQRNFDEGPGGKSPYGGNMIEKMLGHCTFEKDEPRAAKGSYSAEYFRLLQDVNHLRLVKNNGESSALTAEQKQIYIDLVMKSATASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIELINNPVVRRAVSQTIRVINAVVREYGAPEVVRVELAREMGKPYDVRTQITKKQEANAKKNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKVTQYTKHRECIRKTKEGYLDTETGELMTREAYDAKYSPRFPAPWERFRQELEARLSDNPAEEIARLHLATYDSEEEIKPVFVS

SEQ ID NO: 1576 - protein, 1100 aa, unidentified; identical to SEQ ID NO: 1574
  REGION 1..1100: note = Description of Unknown: uncultivated organism with predicted taxonomy: Clostridiales
  REGION 1..1100: note = MG21-66 effector

SEQ ID NO: 1577 - protein, 1100 aa, unidentified; identical to SEQ ID NO: 1539
  REGION 1..1100: note = Description of Unknown: uncultivated organism with predicted taxonomy: Clostridia
  REGION 1..1100: note = MG21-67 effector

SEQ ID NO: 1578 - protein, 1100 aa, unidentified
  REGION 1..1100: note = Description of Unknown: uncultivated organism with predicted taxonomy: Clostridiales
  REGION 1..1100: note = MG21-68 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1579 - protein, 1109 aa, unidentified
  REGION 1..1109: note = Description of Unknown: uncultivated organism with predicted taxonomy: Firmicutes
  REGION 1..1109: note = MG21-69 effector
MKKGQKHCHYTLGLDIGIASIGWAVLGNDEDGTPNRIIDLGVRIFESAEVQKTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGIIKTAILENQQRMERGGYRTIGEMMYRDAAFWETINGIRYHCTRNKAGDYRFTVDRASILAEVSILFEAQRRLGSPWASVEMEDAYTAILSGQRSFDEGPGNDSHGNESPFRKAMSHNVGNCTLIPTELRAARADYTAEYFKLLQDLNHMRLMDNSGSHPLTQQQRAILEEMAFRSANLTYGQLRKKLGLSDEVRFAGLYYGEDTIEKAEKRKWAQMQSYHKIRTALDKVSKNAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDNYSNRKEMKLDAVRIELAREMHHSIKERNRMKKRQEENREKNEQVKAQILETKPGTRVTGLDIVKFKLHQEQKGFCPYSGVEIKKERLYEPGYAEVDHIIPYSRCFDDSYSNKVLVLAEENRQKGNRTPYEYFGADEQRWHEFSARVRASVQDFKKRQKLLNTSFGEEQKNEFTQRNLNDTQHITRVVYNYLRNNLEFADSAYAKAPVRAVNGAVTAMLRGRWGIEKMRGNGDLHHCKDAVVIAATSRSMVQRLTNYYKEEERLFMGKTNFVDPATGEVLTRKEFQQRFAPKFPQPWDRFREELEARLDPIDPMEAVTALYLSTYEPEEEIAPVFVSHMPKHTVTGAAHEETIRSRTETGTVVKTALTSLKLDKNGEIDGYYNPQTDPRLYQALVERLRQFDGEGKKAFAEPFYKPKKDGTPGPRVDKVKIERKSSLSVSTGRGVADNGRMVRIDVFRVPDDGYYFVPIYVADTKKGILPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 1580 - protein, 1117 aa, unidentified
  REGION 1..1117: note = Description of Unknown: uncultivated organism with predicted taxonomy: Firmicutes
  REGION 1..1117: note = MG21-70 effector
MKKRKKKKKDKKDCHYTLGLDIGIASIGWAVLGNDEDGKPNRIIDLGVRIFDKAEVENTGESLAAPRRDARSARRRLRRHRHRLERIRYLLVQQGVLTQEEMTHLYDKNDMVSPYQLRTEGLDRLLNAREFSKVLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSSQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGQDTIEKAEKRKWAQMQSYHKIRTALDKVSKDAIQTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVNAVVRIYGKPDAVRIELAREMSHSFDERNKMKKRQEDGWRKNEQVKAQILETKTGNRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVRAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYSPQTDPRIYQALVERLRQFNGKGEKAFAEPFYKPKKDGTPGPRVDKVKIERKSSLSVSTGRGVADNGRMVRMDVFRVPNERKPDDSYYFVPIYVADTKKGILPSKAVVAHKSPENWKQMKPEHFLFSLFKGDLIYVENSKGISLALAKEAVGEKTIQVKSGLFYFCGADISDGSIKIETHDRCYYKKSLGLKELDTVEKRQVEVLGEVRKVKLPEKRLEFRGRK

SEQ ID NO: 1581 - protein, 1107 aa, unidentified; identical to SEQ ID NO: 1534
  REGION 1..1107: note = Description of Unknown: uncultivated organism with predicted taxonomy: Clostridiales
  REGION 1..1107: note = MG21-71 effector

SEQ ID NO: 1582 - protein, 977 aa, unidentified
  REGION 1..977: note = Description of Unknown: uncultivated organism
  REGION 1..977: note = MG21-72 effector
VLIHLAQRRGYQSNSTAEEAKNEKENGIIKSAILENQQRMERGGYRTIGEMMYRDAAFWETINGIRYHCTRNKAGDYRFTVDRASILSEVSILFEAQRRLGSPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGLSDEVRFAGLYYGEDTIEKAEKRKWPQMQSYHKIRTALDKVSKNAIRTLTQDQLDAIGEILAGGVSDAKRINSFCLEGIPEEYHKALLPLSISKRAKLSIAAMRKLIPFLQQGMRYDEACKAAGLDFHGADGKVEKLSDFLNEITNPVVRRAVSQTIKVVKAVVDTYSKREEMKLDAVRIELAREMHHSIKERNRMKKRQEENREKNEQVKAQILETKPGTRVTGLDIVKFKLYQEQKGFCPYSGVEIKKERLYEPGYAEVDHIIPYSRCFDDSYSNKVLVLAEENRQKGNRTPYEYFGADEQRWHEFSARVRASVRDFKKRQKLLNTSFGEEQGKDFIQRNLNDTQHITRVVYNYLRNNLEFADSAYAKAPVQAVNGAVTAMLRGRWGIEKMRGDGDLHHCKDAVVIAATSDSMIKDLTKYYQEEEQLFMGKTNFVDPATGEVLTRKEFQQRFAPKFPQPWPRFREELEARLDPTNPKEALMALNLSTYEFDPEEEIPPVFVSHMPKHTVTGAAHKETIRGKTETGTVVKTALTSLKLDKNGEIDGYYNPQTDPRLYQALVERLRQFDGEGKKAFAEPFYKPKKDGTPGPRVDKVKIAEKASLSVSTGRGVADNGEMIRMDVFRVPNERKPDDSYYFVPIYVADTKKGILPWKQMKPEHFLFSIFKGDLIYVESKKEISLALAKEAVGEKTIQVKSGLFYFCGANISNGSIEIETHDRRYGKEGLGIKKLKVFEKRQVEVLGEVKKVKLPEKRLEFRGRK

SEQ ID NO: 1583 - protein, 1100 aa, unidentified
  REGION 1..1100: note = Description of Unknown: uncultivated organism with predicted taxonomy: Clostridiales
  REGION 1..1100: note = MG21-73 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIASLRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNLLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1584 - protein, 1097 aa, unidentified
  REGION 1..1097: note = Description of Unknown: uncultivated organism with predicted taxonomy: Firmicutes
  REGION 1..1097: note = MG21-74 effector
MNMESKHYTLGLDIGIASIGWAVLNNNVDGTPDRIIDLGVRLFESAEVQNTGESLAAPRRNARSARRRLRRHRHRLERIRYLLVQQGVLTQEEMTHLYDKCSMLSPYQLRTEGLDRILNAQEFSRVLIHLGQRRGYLSNSTAEEAKNEKENGVIKSAILENQQRMEHGGYRTIGEMMYRDAAFWETINGIRYHCTRNKAGNYHFTVDRASILSEVHILFEAQRRLGSPWASQETEDTYAAILSSQRSFDEGPGGDSPFRKGISERVGNCTLIPTELRAAKADETFEYFKLLQDLNHMRLVDSNGSHPLTQQQRALLEAAAFRTANLTYGQLRKKLGISDEVRFAGLYYGQDSIEKAEKRKWAQMQSYHKIRTALDKVSKDAISMLTQDQLDAIGEIVTAYKADAARIEHLQAAGIPKEYHNALLSLSFSKYGKLSCCAMRKLIPFLQQGMRYDEACKAAGMNFHGANGNVEKLSDFLDEITNPVVRRAVSQTIKVVNAVVRTYGNPDAVRIELAREMSHSFDERNKIKKRQEDGRRKNEQIKAQILETKAGHRVTGLDIVKFKLFQEQDGVCPYSGKALDVQRLYEPGYADVDHIIPYSRCFDDSYSNKVLVLASENRQKGNCTPYEYFGADERRWHEFSVRVGASVRDFKKRQKLLNTSFGEEQGKEFIQRNLNDTQHITRVVYNYLRNNLSFADSTYANAPVQAVSGTVTATLRGRWGIEKMREDGDLHHCKDAVVIAATSPSMIQRLSNYYKEEERLFMGKTHFVDPETGEVLTRKAFQQRFAPKFPQPWDRFREELEARLDPVNPMDAVMALHLSTYEPDEDITPVFVSHMPKHTVTGAAHEETIRGKTETGTVAKTALTALKLDKHGEIEGYYNPQTDPRLYQALVERLKQFGGDGAKAFVEPFYKPKKDGTPGPRVDKVKIAKKASLSVSTGRGVADNGNMVRIDVFHVPDDGYYFVPIYVADTKKAALPSKAVVAHKLPEAWKQMKPEHFLFSLFKGDLIQLENRKGISLLLTKEAIGEKTIQVKSGLFYFCGADISNGSIEIETHDRRYGKKSLGLKTLTAIEKYQVDVLGNVNKVKLPEKRLEFRGRK

SEQ ID NO: 1585 - protein, 1127 aa, unidentified
  REGION 1..1127: note = Description of Unknown: uncultivated organism with predicted taxonomy: Clostridiales
  REGION 1..1127: note = MG21-75 effector
MNYRIGLDLGIASVGWAVLEDDYTGKPKRIVKLGARIFDSAENPKDGSSLALNRRETRETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRVLLKVRNTTDDYKNTPLRKLLLDETKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLEGNERFNMIHYKATNVFSDEINKKAEKERKFKEFESYHKMRVAMDKAEKNYILKLSTDELDVIGTVLTLYKNDNKRIEKLAQLNLPENIINEILKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGICVYSGKRISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNICDTQYISRLMYNLIKNHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1586 - protein, 1100 aa, unidentified
  REGION 1..1100: note = Description of Unknown: uncultivated organism with predicted taxonomy: Clostridiales bacterium 42_27
  REGION 1..1100: note = MG21-76 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1587 - protein, 1098 aa, unidentified
  REGION 1..1098: note = Description of Unknown: uncultivated organism with predicted taxonomy: Clostridiales
  REGION 1..1098: note = MG21-77 effector
LSLRYTLGLDIGIASVGWAVLEDNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGAKSPYGGNMIEKMLGHCTFEKDEPRAAKGSYSAEYFRLLQDVNHLRLVKNNGESNALTAEQKQIYIDLVMKSATASYAQLRKKLELSNDVSFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPYLEKDMTYAEACKEVYGEHKSSITKKNKLSLFDIEPINNPVVRRAVSQTIRVINAVVREYGAPEVVRVELAREMGKPYDVRTQITKKQEANAKKNEEVKQKIREIKGLEPTGQDIVKFKLFQDQNGVCLYSGQSLDITRLFEAGYVDVDHIIPYSISFDDSYTNKVLVRSPENRQKGNRIPADYFKSDPARWQRFETLVNTRVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIEKYYAPESDRLLYEALKKRLKEFDGNAEKAFAEPFYKPKRDGTRGPLVKKVKIYEKKTITVPVGGGNADNGSMIRVDVFYIEGDGYYYVPIYITDVVKDELPNRAVVTQKSHGEWKVMDDKDFLFSMYPHDLIYVERKEAFTLDAPKNSSLDPTISKTKGFFYYRSFDSGTGSFKIYTHDRSYSKKSLGGKTLSCLKKYTVDVLGNYSEVSLPEKRKPLRG

SEQ ID NO: 1588 - protein, 1100 aa, unidentified
  REGION 1..1100: note = Description of Unknown: uncultivated organism with predicted taxonomy: Clostridiales bacterium 42_27
  REGION 1..1100: note = MG21-78 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEEYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1589 - protein, 1100 aa, unidentified
  REGION 1..1100: note = Description of Unknown: uncultivated organism with predicted taxonomy: Clostridiales
  REGION 1..1100: note = MG21-79 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMFRDERFWQKHPDGTRYHQTRNKAEDYRFTVERAAIVDEVRQIFAAQRRLGVVWMDEDMETAYLSVLESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFNNLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRSGQRTNRLSLKDMEEITNPVVRRAVSQTIKVINAVVRTYGPPDVVRIELAREMSRTFDERRKMEKRQDDNRAANERAKDQISEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRTVYNLIRNHLAFAESAYRKKPVQAVNGAVTAMLRGRWGVQKIREDSDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKIREKATVGLPVRDGIAANGSMVRIDVFYVEDDGYYFVPIYVADTKKESLPNKAVVAYKAYSEWKEMKDENFIFSLYPRDLVCIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1590 - protein, 1100 aa, unidentified
  REGION 1..1100: note = Description of Unknown: uncultivated organism with predicted taxonomy: Clostridiales
  REGION 1..1100: note = MG21-80 effector
MTLQSIRYTLGLDIGIASVGWAVLRNGLDGEPYKIENLGVRIFDKAEVPKTGASLAAPRREARSSRRVVRRRRHRKERIKYLIEQEGIMTQTEMMQLFQNSSFEKSVYEIRVEALDRLLTREEAVRLLIHFAQRRGYKSNSKAEEAKDNENGVIKQAISQNQQSMKEHGYRTFGEMLLMDDRFYYTQPDGARIFIPHNKASDYKVTAERGMLADELHMIFAAQRSLGSLWFSDPFEIAYMDIWSSQRSFDKGPGGDSPYSGNQVEKNWGKCTFEKDKLRAPKASYSAEYFRLLQDVNHLRIVSLDGASFPLNQEQRDTVVVAARKSSSLTYAQLRKKLKLSDDQYFNALYYGDKTTAEVEKKKFGHLQFYRQLRTALDKVEKGAADTLTWEQRDEIARILTVYKADDRRTDELQKAGIPEKYIDALLPLSPTKAMHLSVTAIKKIIPYLEAGMPYSDALSKAYGNQTNASTSSKKHKLSLNDIEEITNPVVRRAVSQSIKVINAIVRQYGAPERVRIELAREMGKNFKDRRMIETRQTDNAAKNERIKAQISEYKSDHITGQDIVKFKLFKEQDGICLYSGKSLDIARLFEPGYVDIDHIIPYSISFDDSYNNKVLVQSSENRQKGNRIPYAYFGQNSDRWEKYETLVNNTVRSYRKRKNLLLKSLSEAQIDGFKQRNLQDTQYLSKVVFRLIEDHLQFAKTAPGKKHTQPVNGAITAQVRKRLGIEKIREDGDLHHAMDAAVIACITPGMIQRITKYAQNHERFYATAKGYVDIKTGEVLTRAQYEAMDDIRFPEPWAGFRLELEARVSDHPQEAIAQLKLPHYENSEEIRPIFVSRMPNHKVTGAAHLETIRSKKGGAGSTVTKTALTELKLGKDGEIAGYCRKEDDPLLYEALKARLKAFGGDGKKAFAEPFHKPKHNGEPGPIVNKVKIQESATLTVPVNHGVAANGSMVRLDVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRLNRRGLGGKTLLSIEKYQVDVLGNYFPVALPEKRMKFR

SEQ ID NO: 1591 - protein, 1100 aa, unidentified
  REGION 1..1100: note = Description of Unknown: uncultivated organism with predicted taxonomy: Clostridiales
  REGION 1..1100: note = MG21-81 effector
MSDFHYALGLDIGIGSVGWAVLRNQPNGEPDRIQDLGVRIFDKAEQPKTGASLAAPRRDARSARRRLRRHRHRLERIRYLMEQHDIMPVSDIQAMYAAGGFEKSPYQLRAEALDRPLSKEELVRVLIHLAQRRGYRSNSTAEAAKNEKETGKVKSAIEENRACMEQHGYRTVGEMMFRDERFWQKHPDGTRCHQTRNKAEDYRFTVERTAIVDEAKQIFTAQRRFGAGWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFHHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAEPFYKPKKDGTPGPRVDKVKICEKATTGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1592 - protein, 1100 aa, unidentified
  REGION 1..1100: note = Description of Unknown: uncultivated organism with predicted taxonomy: Clostridiales bacterium 42_27
  REGION 1..1100: note = MG21-82 effector
MSEFHYALGLDIGIGSVGWAVLRNQPNGEPDRIQDLGVRIFDKAEQPKTGASLAAPRRDARSARRRLRRHRHRLERIRYLMEQHGIMPVADIQAMYAASGFQKSPYQLRAEALDRPLTKEEAVRVLIHLAQRRGYKSNSTAEAAKDEKETGKVKTAIEENRRCMAEHSYRTVGEMMYRDERFWQKHPDGTRYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1593 - protein, 878 aa, unidentified
  REGION 1..878: note = Description of Unknown: uncultivated organism with predicted taxonomy: Clostridiales bacterium 42_27
  REGION 1..878: note = MG21-83 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYQFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIE

SEQ ID NO: 1594 - protein, 1100 aa, unidentified
  REGION 1..1100: note = Description of Unknown: uncultivated organism with predicted taxonomy: Clostridiales
  REGION 1..1100: note = MG21-84 effector
MSEFHYALGLDIGIGSVGWAVLRNQPNGEPDRIQDLGVRIFDKAEQPKTGASLAAPRRDARSARRRLRRHRHRLERIRYMMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLSEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1595 - protein, 1138 aa, unidentified
  REGION 1..1138: note = Description of Unknown: uncultivated organism with predicted taxonomy: Clostridiales
  REGION 1..1138: note = MG21-85 effector
LSLRYTLGLDIGIASVGWAVLKNDINGVPIKIEDLGAVAFSAAEPTGKVQKKKSGSKTPAPTLASNLRKIRCPRRTIRRKRHRKDRIKQLIQQNGIMTRVEMAEMFEHSQFETSVYELRVQALERALTKQEFVRVLIHLAQRRGYKSNSESEEAKDKENGKVKIAISENKQCMEKNGYRTIGEMLLNDDRFWEDNHDGTKIFVPHNHPDDYRTTVERSMVEDEIRLIFSRQRALGVPYATSEFEEAYLKIWGGQRNFDDGPGYEIPPKDDGTGGKYSRYGGNMIEKMLGHCTFEKDEPRAAKGSYSAEYFRLLQDVNHLRLVKNNGESSALTAEQKQIYIDLVMESEAASYEEAASYEELREKLGLSNDILFNMLRYGSDEIGKVERKKLGHMKFYHEMRKALNMVQKDAISTVSWEQRDEIARILLCYKSDDKRKAQLEKLDIPQEFILKLLTLSTSKTAHLSVKALRKLIPYLEEGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQDQNGVCLYSGQNLDITRLFEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYPPRFPAPWERFRQELEARLSDNPAEEIARLHLATYDSEEEIKPVFVSRKPERKTTGAAHKDTIYRKADGGYIDKVPLTKLTLDKKTGEIEKYYAPESDRLLYEALKKRLKEFDGNAKEAFAEPFYKPKRDGTSGPLVKKVKLYEKYNNTVEVKRGDARASNKHIGCARNDSNSMIRVDVFYIEGDGYYYVPIYITDVVKDELPNRAVVTQKSHGEWKVMDDKDFLFSMYPHDLIYVERKEAFTLDALKNSSLDPTISKTKGFFYYRSFDSGTGSFKIYTHDSSYSKKSLGGKTLSCLKKYTVDILGNYSEVSLPEKRKPLRG

SEQ ID NO: 1596 - protein, 1100 aa, unidentified
  REGION 1..1100: note = Description of Unknown: uncultivated organism with predicted taxonomy: Firmicutes
  REGION 1..1100: note = MG21-86 effector
MSDFHYALGLDIGIGSVGWAVLRNRPDGEPDRIQDLGVRIFDKAEQPKTGASLAAPRRDARSARRRLRRHRHRLERIRYLMEQHGIMPVSDIQAMYAAGGFEKSPYQLRAEALDRPLSREELVRVLIHLAQRRGYRSNSTAEAAKNEKETGKVKSAIEENRACMEQHGYRTVGEMMLRDERFWQKHPDGTRCHQTRNKAEDYRFTVERTAIVDEAKQIFTAQRRFGADWMDDGLEAAYLAVLESQRSFDEGPGGDSPFHGGIGERVGFCTFEPDEQRAAKATYTFEYFKLLQDLNHMRLAGNGTAPQPLNAQQREILKAAALQSASLSYGQIRKKLALDENVFFNHLYYGDKPKEEAEKRKWPQMQSYHKMRTALDKVGKGTINTLTETQLNAIATILTQYKSDARRIEALREAGIPAQFDDALLPLSFSKYGNLSVTAMQKLIPLLEQGMRYDEACTQIYGDHRGLHPEQRKNRLSLRDMREITNPVVRRAVSQTIKVVNAVVRTYGPPDVVRIELAREMSQNFEERRKTEKRQDENRTANEKAKEQIAEYKGDRATGLDIVKFKLYREQDGVCLYSGRNLDLSRLFEPGYVDVDHIIPYSRCFDDSYQNKVLVLASENRQKGNRLPYEYFGQDETRWHEYEVRVENLIRNYRKRQKLLKKRLTEEESAGFIDRNLKDTQYITRSIYNLLRDNLAFAESDYRKKPVQTVNGAVTSMLRGRWGVQKIREDGDLHHCMDAAVIAAASPGLVQRLTEYSKRREAFEEVSRGYVDPATGELVELPEQLRRDPFPKPWERFRQELEARLDPIDPRHQIDLLKLATYESDEKIRPVFVSRMPNHKVTGAAHAETIRSSKMGDGYTVTKTPLANLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 1597 - protein, 980 aa, unidentified
  REGION 1..980: note = Description of Unknown: uncultivated organism with predicted taxonomy: Clostridiales
  REGION 1..980: note = MG21-87 effector
EAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1598 - protein, 1098 aa, unidentified
  REGION 1..1098: note = Description of Unknown: uncultivated organism with predicted taxonomy: Clostridiales
  REGION 1..1098: note = MG21-88 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHSQFETSVYELRVQALERALTKQEFVRVLIHLAQRRGYKSNSKSEEAKDKENGKVKIAISENKQCMEENGYRTIGEMLLKDDRFWECNPDGTKIFVPHNHPDDYRTTVERSMVEDEIRLIFSRQHALGVSYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPHEFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKPVFVSRKQTHKISGAAHEATIRSAKKPGGSISKKPLTSLSLNKKTGEIEGYYAPESDRLLYEALKKRLEEFDGNAEKAFAEPFYKPKRDGTRGPLVKKVKIYEKKTITVPVGGGNADNGSMIRVDVFYVEDDGYYYVPIYTADVIKGALPNRAVVAHKSHGEWKVMDDKDFLFSMYPNELLYIESRKGIKLKTKKGSSRQEEIIRKAGLYYFKWLNIAANALFIITHDNGYEQPSLGGKTLSCLKKYTVDALGNYSEVSLPEKRKPLRG

SEQ ID NO: 1599 - protein, 1100 aa, unidentified; identical to SEQ ID NO: 1544
  REGION 1..1100: note = Description of Unknown: uncultivated organism with predicted taxonomy: Clostridiales
  REGION 1..1100: note = MG21-89 effector

SEQ ID NO: 1600 - protein, 1100 aa, unidentified; identical to SEQ ID NO: 1578
  REGION 1..1100: note = Description of Unknown: uncultivated organism with predicted taxonomy: Clostridiales bacterium 42_27
  REGION 1..1100: note = MG21-90 effector

SEQ ID NO: 1601 - protein, 1100 aa, unidentified; identical to SEQ ID NO: 1578
  REGION 1..1100: note = Description of Unknown: uncultivated organism with predicted taxonomy: Clostridiales bacterium 42_27
  REGION 1..1100: note = MG21-91 effector

SEQ ID NO: 1602 - protein, 919 aa, unidentified
  REGION 1..919: note = Description of Unknown: uncultivated organism with predicted taxonomy: Ruminococcaceae bacterium TF06-43
  REGION 1..919: note = MG21-92 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLNPIDPRHQIDLLKLETYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDG

SEQ ID NO: 1603 - protein, 1100 aa, unidentified; identical to SEQ ID NO: 1544
  REGION 1..1100: note = Description of Unknown: uncultivated organism with predicted taxonomy: Ruminococcaceae bacterium TF06-43
  REGION 1..1100: note = MG21-93 effector

SEQ ID NO: 1604 - protein, 1100 aa, unidentified
  REGION 1..1100: note = Description of Unknown: uncultivated organism with predicted taxonomy: Clostridiales
  REGION 1..1100: note = MG21-94 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKMRTALDKVGKDTIGTLTEEQLNAIATILTECKSDAKRIAALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFASRMPNHKVTGAAHAETIRSSKGGDGFTVTKTPLTNLKLNKFGEIEGYYNPASDTLLYNALLSRLKDFGGDGAKAFAQPFYKPKKDGTPGPRVDKVKICEKATIGLPVRNGIAANGSMIRIDVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 1605 - protein, 1036 aa, unidentified
  REGION 1..1036: note = Description of Unknown: uncultivated organism with predicted taxonomy: Clostridiales bacterium 42_27
  REGION 1..1036: note = MG21-95 effector
RRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTHYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1606 - protein, 1100 aa, unidentified; identical to SEQ ID NO: 1578
  REGION 1..1100: note = Description of Unknown: uncultivated organism with predicted taxonomy: Clostridiales bacterium 42_27
  REGION 1..1100: note = MG21-96 effector

SEQ ID NO: 1607 - protein, 1128 aa, unidentified
  REGION 1..1128: note = Description of Unknown: uncultivated organism with predicted taxonomy: Clostridium
  REGION 1..1128: note = MG21-97 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAVKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIAANGDMIRIDVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 1608 - protein, 1134 aa, unidentified
  REGION 1..1134: note = Description of Unknown: uncultivated organism with predicted taxonomy: Clostridiales
  REGION 1..1134: note = MG21-98 effector
LSLRYTLGLDIGIASVGWAVLKNDINGVPIKIEDLGAVAFSAAEPTGKVQKKKSNSKTPAPTLASNLRKIRCPRRTIRRKRHRKDRIKQLIQQNGIMTRVEMAEMFEHSQFETSVYELRVQALERALTKQELVRVLIHLAQRRGYKSNSKSEEAKDKENGKVKIAISENKQCMEENGYRTIGEMLLNDDRFWEDNHDGTKNFVPHNHPDDYRTTVERSMVEDEIRLIFSRQRALGVPYATSEFEEAYLKIWGGQRNFDDGPGYEIPPKDDGTEGKYSRYGGNMIEKMLGHCTFEKDEPRAAKGSYSAEYFRLLQDVNHLRLVKNNGESSALTAEQKQIYIDLVMKSATASYAKLRKKLDLSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPHLEKGMTYAEACKEVYGEQKISVTKKNKLSLFDIEPINNPVVRRAVAKTIRVINAVVRKYGPPEVVRVELAREMGKSKADRDKIDAEQKANAKRNEELRQQIKKIKGAEPTGQDIVKFKLFQEQKGVCLYSGKNIEIDRLFKPEAGYVEIDHIIPYSISLDNSYANKVLVLKEENQNKGRRTPYEYFGADSKRWQRFETLVNTQVHNWKKKRNLLTQALSEEQKNGFKQRNLVDTQYIARVIYNLINDHLQFAETGKYDKKRRTQAVNGAITAHVRKRLGIQKIREDGDLHHAADAAVVACVSPSMIQKITQYTKHRECIRETPKGYLDTETGELMTREAYDAKYSPRFPAPWERFRQELEARLSDNPAEEIARLHLATYDSEEEIKPVFVSRKPKRKTTGAAHKDTIYRKTDGGYIDKVPLTKLTLDKKTGEIEKYYAPESDRLLYEALKKRLEEFDGNAKEAFAEPFYKPKRDGTRGPLVKKVKLYETYNNTVEVKRGDARASNKHIGCARNDSNSMIRVDVFYIEDDGYYYVPIYITDVVKDELPNKAVVQKKLPKDWKEMDDRDFLFSMYPNELLYIESRKGIKLKTKKGSSRQEEIIRKAGLYYFKRLDIASGNLFIITHDHSYEQPSLGGKTLSCLKKYTIDVLGNYSEVSLPEKRKPLRG

SEQ ID NO: 1609 - protein, 1100 aa, unidentified; identical to SEQ ID NO: 1538
  REGION 1..1100: note = Description of Unknown: uncultivated organism with predicted taxonomy: Clostridiales bacterium 42_27
  REGION 1..1100: note = MG21-99 effector

SEQ ID NO: 1610 - protein, 1100 aa, unidentified
  REGION 1..1100: note = Description of Unknown: uncultivated organism with predicted taxonomy: Clostridiales
  REGION 1..1100: note = MG21-100 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVYLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1611 - protein, 1127 aa, unidentified
  REGION 1..1127: note = Description of Unknown: uncultivated organism with predicted taxonomy: Clostridiales
  REGION 1..1127: note = MG21-101 effector
MNYRIGLDLGIASVGWAVLEDDYMGKPKRIVKLGARIFDSAENPKDGSSLALNRREARETRRRLRRRNHRIKRTKNLLEKYNIMTTKEIEDMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKTKVTLTYASLRIALNLAGNERFNMIHYKATNVFSDEINKEAEKERKFKEFESYHKMRVSMDKAEKNYILKLSTDELDVIGTVLTLYKNDNKRIEKLAQLNLPENIINEMLKLSFSKVGNLSIKAMKKIIPYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKNHVQFSNNENFERKVFTVNGQITSHIGKRLGINKIRENGDEHHATDAVIIATVSQGMIQRITKYYQYIDGRYEKNSGEYIDMETGEIITKEQYEAKNGSNFPEPWPKFRKELDIRTTCKTKARMEECLLTEKIFYDDYDDVKPIFISRMPKRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKLYAEWKEMQDKDFIFSLYPRDLFYVKSKNKIKLTSINKQDKESLETNELFAYYVKAGISTAAIACINHNGEYEQNSLGIKRLQEFKKYEVDVLGNYHEVKLPEKRQDFSNLKKGGSLK

SEQ ID NO: 1612 - protein, 1128 aa, unidentified; identical to SEQ ID NO: 1554
  REGION 1..1128: note = Description of Unknown: uncultivated organism with predicted taxonomy: Clostridium
  REGION 1..1128: note = MG21-102 effector

SEQ ID NO: 1613 - protein, 1100 aa, unidentified
  REGION 1..1100: note = Description of Unknown: uncultivated organism with predicted taxonomy: Clostridiales
  REGION 1..1100: note = MG21-103 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKCPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1614 - protein, 1100 aa, unidentified
  REGION 1..1100: note = Description of Unknown: uncultivated organism with predicted taxonomy: Clostridiales bacterium 42_27
  REGION 1..1100: note = MG21-104 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1615 - protein, 1100 aa, unidentified
  REGION 1..1100: note = Description of Unknown: uncultivated organism with predicted taxonomy: Clostridiales bacterium 42_27
  REGION 1..1100: note = MG21-105 effector
MSEFHYALGLDIGIGSVGWAVLRNQPTGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLNRMRLTGMGMPPEPLDDEQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1616 - protein, 786 aa, unidentified
  REGION 1..786: note = Description of Unknown: uncultivated organism with predicted taxonomy: Oscillibacter sp. CAG:241_62_21
  REGION 1..786: note = MG21-106 effector
MLEFHYALGLDIGIGSVGWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQ

SEQ ID NO: 1617 - protein, 1128 aa, unidentified
  REGION 1..1128: note = Description of Unknown: uncultivated organism with predicted taxonomy: Clostridium
  REGION 1..1128: note = MG21-107 effector
MNYRIGLDLGIASVGWAILEDDNKGNPKRIVKLGSRIFDAAENPKDGSSLALNRREARNTRRRLRRRNHRIKRTKNLLEKYNIITIKEIENMYATYKFQFNPYELRVKGLDEKLTNSELARVLISFVKRRGYKSNSKAEETSNKEMGKLLVATKENEILMKEKNYRTIGEMYLKDEKFKIQMPDGRVLFKVRNTTDEYKNTPLRKLLLDEIKQILEKQKELNSNITDSFIDEYINIFTSQRNFDDGPSQPSIYAGNQIEKMLGKCTFEKEENRSAKATYTFEYFKLLQDINHIKIEEYHLKENGTREVIKRTLTEEERNIIINLAKTKVTLTYDSLRTALKLTTNERFNMINYKRTDIFNDEENKKVEKDRRIKEFESYHKIRVAMDRIEKNYINKLNSDDLDTIGTVLTLYKNDNKRIEKLKEINLPEDIVNELLKLSFSKVGNLSIKAMKKIIPYLEQGYTYDKAVNEVYEDFRGIINTKKKKKIALRDLEQELSNPVVKRAVSQAIKVLNAITTTYGKPDIINIELARQLSKKFADRQNIKKKQEQNMQNNDKAREEILKLGKNNPTGQDIVKYKLWQEQDGICVYSGKHISIEDLFTEAVDVDHIIPYSMCFDDTYKNKVLVLASENRQKGNRIPYQYLKEKGRNLEEYEVRVNNIIKNYYKKKRLLRQNFTREDATEWKDRNIQDTQYISRLMYNLIKNHVQFSDNENFDRKVFTVNGQITSHVRKRLGINKIRENGDEHHAVDAAVIAIISQGMIQKITKYYQYIDGRYEKNSGEYIDLETGEILTKEQYEKENGINFPEPWPKFRTELDIRTTCQTKERMEECLVAEKIYYENYDDVKPVFISRMPRRKVTGQAHLDTIRGIRKNEEGIKTLTKTELTKLKLDKNGEIEKYPDSQKQDDKLLYKALVDQLRKFGGNGEEAFKRPFYKPKSDGTPGPLVKKVKLEDKTTLAVELNNGKAIVANGDMIRIDVFKVDGEGYYFVPIYVSDTIKSKLPNKACVAAKQYSEWKDMKDENFIFSLYPRDLIYIKSKNKIKLTSINKENKENKEISEMFAYYIKSGISTATISIINHNGEYEQNSLGIKTLKEFKKFEVDVLGNYHEVKLPEKRQSFKNLKKKGGSLK

SEQ ID NO: 1618 - protein, 1100 aa, unidentified; identical to SEQ ID NO: 1544
  REGION 1..1100: note = Description of Unknown: uncultivated organism with predicted taxonomy: Clostridiales
  REGION 1..1100: note = MG21-108 effector

SEQ ID NO: 1619 - protein, 1045 aa, unidentified
  REGION 1..1045: note = Description of Unknown: uncultivated organism with predicted taxonomy: Clostridiales bacterium 42_27
  REGION 1..1045: note = MG21-109 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAG

SEQ ID NO: 1620 - protein, 1100 aa, unidentified
  REGION 1..1100: note = Description of Unknown: uncultivated organism with predicted taxonomy: Oscillibacter sp. CAG:241_62_21
  REGION 1..1100: note = MG21-110 effector
MLEFHYALGLDIGIGSVGWAVLRNQENGEPDRIQDLGVRIFDKAEQSKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADNYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELCYGDHSREDAEKRKWPQMQSYHKIRTALDKVGKGTISTLTEEQLNAIAEILTRYKSDAKRIAALREAGIPPQLDGALLPLSFSKYGSLSVKAMQKLIPLLEKGQRYDQACTQIYGDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1621 - protein, 1100 aa, unidentified
  REGION 1..1100: note = Description of Unknown: uncultivated organism with predicted taxonomy: Clostridiales
  REGION 1..1100: note = MG21-111 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRRSKGGDGFTVTKTPLTNLKLNKFGEIEGYYNPASDTLLYDSLLARLKDFGGDGAKAFAQPFYKPKKDGTPGPRVDKVKICEKATIGLPVRNGIAANGSMIRIDVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1622 - protein, 1100 aa, unidentified; identical to SEQ ID NO: 1538
  REGION 1..1100: note = Description of Unknown: uncultivated organism with predicted taxonomy: Clostridiales bacterium 42_27
  REGION 1..1100: note = MG21-112 effector

SEQ ID NO: 1623 - protein, 1100 aa, unidentified; identical to SEQ ID NO: 1614
  REGION 1..1100: note = Description of Unknown: uncultivated organism with predicted taxonomy: Clostridiales bacterium 42_27
  REGION 1..1100: note = MG21-113 effector

SEQ ID NO: 1624 - protein, 1028 aa, unidentified
  REGION 1..1028: note = Description of Unknown: uncultivated organism with predicted taxonomy: Clostridiales bacterium 42_27
  REGION 1..1028: note = MG21-114 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKIAIEENRRCMAEHGYRTVGEMMYRDERFWQKHPDGTRYHQTRNKAEDYRFTVERAAIVDEVRQIFAAQRRLGTAWMDEDMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVSKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLTFAESNYRKKPVQAVNGAVTAMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTG

SEQ ID NO: 1625 - protein, 1107 aa, unidentified
  REGION 1..1107: note = Description of Unknown: uncultivated organism with predicted taxonomy: Clostridiales
  REGION 1..1107: note = MG21-115 effector
LSLRYTLGLDIGIASVGWAVLENNIDGEPIKIERLGVRIFDKAEQPKTGASLAEPRREARGQRRTIRRRRHRKDRIKQLIQQNGIMTRVEMTEMFEHSQFETSVYELRVQALERALTKQEFVRVLIHLAQRRGYKSNSKSEEAKDKENGKVKSAISENKKCMEENGYRTIGEMLLNDDRFWEYNPDGTKIFVPHNHPDDYRTTVERSMVEDEIRLIFSRQHALGVPYATSEFEEAYLEIWGRQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAIATVSWEQRDEIARILLCYKSDDKRKAQLEKLDIPREFIPALLTLSTSKTAHLSAKALRKLIPHLEKGMTYAEACKEVYGEQKSSITKKNKLSLFDIEPINNPVVRRAVSQTIRVINAVVREYGAPEVVRVELAREMGKPYDVRTQMTKKQETNAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWQRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHKDTIYRKADGGYIDKVPLTRLTLDKQTGEIKNYYAPESDRLLYEALKKRLEEFDGNAEKAFAEPFYKPRRDGTRGPLVKKVKLYETYNNTVEVKRGDARASNKHIGCAKNDSMIRVDVFYMEDDGYYYVPIYTADVIKGVLPNKAVVRNKLPEDWKEMDDRDFLFSMYPNDLLYIESRRGIKLKTKKGSSRQEEIVRKTGLYYFKGLNIATNALFIITHDNGYEQPSLGGKTLSCLKKYTVDALGNYSEVSLPEKRKPLRG

SEQ ID NO: 1626 - protein, 1100 aa, unidentified; identical to SEQ ID NO: 1544
  REGION 1..1100: note = Description of Unknown: uncultivated organism with predicted taxonomy: Clostridiales
  REGION 1..1100: note = MG21-116 effector

SEQ ID NO: 1627 - protein, 1100 aa, unidentified; identical to SEQ ID NO: 1548
  REGION 1..1100: note = Description of Unknown: uncultivated organism with predicted taxonomy: Clostridiales bacterium 42_27
  REGION 1..1100: note = MG21-117 effector

SEQ ID NO: 1628 - protein, 897 aa, unidentified
  REGION 1..897: note = Description of Unknown: uncultivated organism with predicted taxonomy: Clostridiales bacterium 42_27
  REGION 1..897: note = MG21-118 effector
FTVERAAIVDEVRQIFAAQRRLGVVWMDEDMETAYLSVLESQRSFDEGPGGDSPFSGGIGKRVGACTFEPDEKRAAKATYTFEYFKLLQDLNRMRLTGMGMPPEPLDDEQREVLKSAALRSASLSYGQIRKKLNLDDDVFFNDLYYGEKTKEEAEKRKWPQMQSYHKLRMALDKVGKGAIGTLTEEQLNAIATILTECKSDAKRIAALREAGIPPQFDEALLPLSFSKYGSLSVRAMQKLIPLLEEGLRYDEACTRVYGDHRGLRSEQRTNRLSLNDMEEITNPVVRRAVSQTIKVINAVARTYGPPDVVRIELAREMSRTFDERRKMEKRQDDNRAANEQAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTSMLRGRWGVQKIREDGDLHHCLDAAVIAATTPGLVQRLTAYNKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMIRIDVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 1629 - protein, 1100 aa, unidentified; identical to SEQ ID NO: 1578
  REGION 1..1100: note = Description of Unknown: uncultivated organism with predicted taxonomy: Clostridiales bacterium 42_27
  REGION 1..1100: note = MG21-119 effector

SEQ ID NO: 1630 - protein, 1100 aa, unidentified
  REGION 1..1100: note = Description of Unknown: uncultivated organism with predicted taxonomy: Ruminococcaceae bacterium TF06-43
  REGION 1..1100: note = MG21-120 effector
MSEFHYALGLDIGIGSVGWAVLRNQPNGEPDRIQDLGVRIFDKAEQPKTGASLAAPRRDARSARRRLRRHRHRLERIRYLMEQRGMMSVSDIQAMYAAGGFQKSPYQLRAEALDRPLSKEEAVRVLIHLAQRRGYKSNSTAEAAKDEKETGKVKTAIEENRRCMAEHDYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVGFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRMAGIPVQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGYDEVRWHEYEVRVENLIRNYRKRQKLLKRQLSEEESAEFIDRNLKDTQYITRTVYNLIRDHLAFAESAYRKKPVQAVNGAVTSMLRNRWGVQKIREDGDLHHCLDAAVIAATTPGLVQRLTAYSKHRETWERPPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLMNLKLNKFGEIEGYYNPASDTLLYDALLARLKDFGGDGAKAFAQPFYKPKKDGTPGPRVDKVKICEKATVGLPVRDGIAANGSMVRIDVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 1631 - protein, 1100 aa, unidentified
  REGION 1..1100: note = Description of Unknown: uncultivated organism with predicted taxonomy: Clostridiales
  REGION 1..1100: note = MG21-121 effector
MSEFHYALGLDIGIGSVGWAVLRNQPNGEPDRIQDLGVRIFDKAEQPKTGASLAAPRRDARSARRRLRRHRHRLERIRYLVEQRGMMSVSDIQAMYAAGGFQKSPYQLRAEALDRPLSKEEAVRVLIHLAQRRGYKSNSTAEAAKDEKETGKVKTAIEENRRCMAEHGYRTVGEMMYRDERFWQSNPDGTRYQQTRNKTDDYRFTVERSAIVDEAKQIFAAQRKLGADWSSEDLEAAYLSILEGQRSFDEGPGGESPFRGGIGDKVSFCTFEPDQQRAAKATYTFEYFKLLQDLNHMRLAGRGMSPQPLNAQQREILKETALRSASLSYGQLRKKLALADDTFFSGLYYGDKSREEAEKRKWPQMQSYHKIRTALDKVGKGTISSLTEEQLNAIASILTQYKSDAKRIEALRLAGIPMQFDEALLPLSFSKYGSLSVQAMQKLIPLLEQGMRYDEACTQIYGDHRGLHSEQRKNRLSLTDMDEITNPVVRRAVSQTIKVINAIVRTYGPPDVVRIELAREMSRNFDERRKAEKRQDENRAANERAKEQIAEYKGDHATGLDIVKFKLYQEQDGVCLYSGKNLDPSRLFEPGYADVDHIVPYSRCFDDSYQNKVLVLASENRQKGNRLPYEYFGQDEARWHGYEVRVENLIRNYRKRQKLLKRQLSEEESAGFIDRNLKDTQYITRSIYNLIRNNLVFAESNYKKRPVQTVNGAVTSMLRNRWGVQKIREDGDLHHCLDAAVIAATTPGLVQRLTEHSKRRETLEKAPAGYVDPATGELLELPQEARRDLFPKPWERFRQELEARLDPIDPRHQIDLLKLSTYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATIGLPVRNGIAANGSMIRIDVFYVEDDGYYFVPIYVVDTKKENLPNKAVVAYKAYSDWKEMRDEDFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 1632 - protein, 1109 aa, unidentified; identical to SEQ ID NO: 1579
  REGION 1..1109: note = Description of Unknown: uncultivated organism
  REGION 1..1109: note = MG21-122 effector

SEQ ID NO: 1633 - protein, 1100 aa, unidentified; identical to SEQ ID NO: 1538
  REGION 1..1100: note = Description of Unknown: uncultivated organism with predicted taxonomy: Clostridiales
  REGION 1..1100: note = MG21-123 effector

SEQ ID NO: 1634 - protein, 943 aa, unidentified
  REGION 1..943: note = Description of Unknown: uncultivated organism with predicted taxonomy: Clostridiales bacterium 42_27
  REGION 1..943: note = MG21-124 effector
EENRRCMAEHGYRTVGEMMYRDERFWQKHPAGPRYRQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1635 - protein, 1100 aa, unidentified; identical to SEQ ID NO: 1538
  REGION 1..1100: note = Description of Unknown: uncultivated organism with predicted taxonomy: Clostridiales bacterium 42_27
  REGION 1..1100: note = MG21-125 effector

SEQ ID NO: 1636 - protein, 772 aa, unidentified
  REGION 1..772: note = Description of Unknown: uncultivated organism with predicted taxonomy: Clostridiales bacterium 42_27
  REGION 1..772: note = MG21-126 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVAAMLRGRWGVQKIREDGDLHHCLDAAVIAATTPGLVQRLTAYNKHRETWERSPAGYVD

SEQ ID NO: 1637 - protein, 970 aa, unidentified
  REGION 1..970: note = Description of Unknown: uncultivated organism with predicted taxonomy: Clostridiales bacterium 42_27
  REGION 1..970: note = MG21-127 effector
QRRGYKSNSTAEAAKDEKETGKVKTAIEENRRCMAEHGYRTVGEMMYRDERFWQIHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRTNRLSLNDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLNEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLNPIDPRHQIDLLKLETYESDEEIKPVFVSRMPNHKVTGAAHAETIRSSKGGDGFTVTKTPLANLKLNKFGEIEGYYNPASDTLLYDALLARLKAFGGDGAKAFAQPFYKPKKDGTPGPRVDKVKICEKATVGLPVRDGIAANGSMVRIDVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1638 - protein, 964 aa, unidentified
  REGION 1..964: note = Description of Unknown: uncultivated organism with predicted taxonomy: Clostridiales bacterium 42_27
  REGION 1..964: note = MG21-128 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYY

SEQ ID NO: 1639 - protein, 820 aa, unidentified
  REGION 1..820: note = Description of Unknown: uncultivated organism with predicted taxonomy: Clostridiales bacterium 42_27
  REGION 1..820: note = MG21-129 effector
MYRDERFWQKHPDGTRYHQTRNKAEDYRFTVERAAIVDEVRQIFAAQRRLGTVWMDEDMETAYLSILESQRSFDEGPGGDSPFFGGIGERVGACTFEPDEKRAAKATYTFEYFKLLQDLNRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLRPEQRTNRLSLNDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIARNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGTPGPRVDKVKICEKATVGLPVRDGIAANGSMVRIDVFYVEGDGYYFVPIYVADTKKESLPNKAVVAYKAYSEWKEM

SEQ ID NO: 1640 - protein, 889 aa, unidentified
  REGION 1..889: note = Description of Unknown: uncultivated organism with predicted taxonomy: Clostridiales bacterium 42_27
  REGION 1..889: note = MG21-130 effector
VDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGAHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1641 - protein, 1100 aa, unidentified; identical to SEQ ID NO: 1614
  REGION 1..1100: note = Description of Unknown: uncultivated organism with predicted taxonomy: Clostridiales bacterium 42_27
  REGION 1..1100: note = MG21-131 effector

SEQ ID NO: 1642 - protein, 1100 aa, unidentified
  REGION 1..1100: note = Description of Unknown: uncultivated organism with predicted taxonomy: Clostridiales bacterium 42_27
  REGION 1..1100: note = MG21-132 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFPKSPYQLRAEALDRPLTKEEAVRVLIHLAQRRGYKSNSTAEAAKDEKETGKVKTAIEENRRCMAEYGYRTVGEMMYRDERFWQKHPDGTHYHQTRNKAEDYRFTVERAAIVDEVRQIFAAQRRLGTVWMDEDMETAYLSILESQRSFDEGPGGDSPFSGGIGERVGACTFEPDEKRAAKATYTFEYFKLLQDLSRMRLTGMGMPPEPLDAAQREALKSAALRSASLSYGQIRKKLNLDDDVFFHGLYYGEKTKEETEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1643 - protein, 1100 aa, unidentified
  REGION 1..1100: note = Description of Unknown: uncultivated organism with predicted taxonomy: Clostridiales
  REGION 1..1100: note = MG21-133 effector
MLEFHYALGLDIGIGSVVWAVLRNQENGEPDRIQDLGVRIFDKAEQPKTGASLAAPRRDARSARRRLRRHSHRLERIRFLMEQSGILSVADIQEMYSTGGFQKSPYQLRAEALDRLLTKEEAVRVLIHLAQRRGYKSNSTAEAAKDEKETGKVKTAIEENRRCMEEHGYRTVGEMMFRDERFWQKNPDGSRYHQTRNKADDYRFTVERAAIVDEAKRIFAAQRSFGAAWMGEAVEASYLSILESQRSFDEGPGGSSPFRGGIGERVGFCTFEPEERRAPKASYTFEYFKLLQDLNRMRLAGMGLPPQPLNAEQRELLKTAALRSASLNYGQIRKKLNLDDGIYFNELYYGDHSREDAEKRKWPQMQSYHKIRTALDRVGKGTISTLTEEQLNAIAEILTRYKSDAKRIAALREAGIPPQLDGALLPLSFSKYGSLSVKAMQKLIPLLEKGQRYDQACTQIYRDHRGLRTDQRTTRLSLHDMDEITNPVVRRAVSQTIKVVNAVVRTYGPPDVVRIELAREMSQNFDERRKAEKRREENRAANERAKEQILEYKGDRVTGLDIVKFKLFREQDGVCLYSGKNLDISRLFEPGYADVDHIIPYSRCFDDSYQNKVLVLASENRQKGNRLPYEYFGQDAARWHGYEVRVENLIRNYRKRQKLLKHHLTEEESAGFIARNLKDTQYITRTIYNLLREHLLFADSRYSKKPVQAVNGAVTAMLRSRWGVHKIREDGDLHHCMDAAVLAATTPGLVQRLTEYSKHRETLIETPAGFVNRLTGELVEEAGDAQRDRFPEPWDRFRQELEARLDPIDPRHQIDRLKLATYESDEELKPVFVSRMPNHKVTGAAHAETIRSSKAGNGFTVTKTPLASLKLNKQGEIDGYYNPESDKLLYDALLARLKAFGGDGAKAFAEPFYKPKKDGTPGPRVDKVKIREKGTTGLPVRDGIAANGSMIRIDVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 1644 - protein, 1100 aa, unidentified; identical to SEQ ID NO: 1614
  REGION 1..1100: note = Description of Unknown: uncultivated organism with predicted taxonomy: Clostridiales bacterium 42_27
  REGION 1..1100: note = MG21-134 effector

SEQ ID NO: 1645 - protein, 1100 aa, unidentified; identical to SEQ ID NO: 1538
  REGION 1..1100: note = Description of Unknown: uncultivated organism with predicted taxonomy: Clostridiales
  REGION 1..1100: note = MG21-135 effector

SEQ ID NO: 1646 - protein, 1018 aa, unidentified
  REGION 1..1018: note = Description of Unknown: uncultivated organism with predicted taxonomy: Clostridiales
  REGION 1..1018: note = MG21-136 effector
LYDKSDMVSPYQLRTEGLDRLLNAREFSKVLIHLAQRRGYQSNSTAEEAKNEKENGIIKTAILENQQRMGRGGYRTIGEMMYRDAAFWETINGIRYHCTRNKAGDYRFTVDRASILAEVSILFEAQRRLGAPWASVEMEDAYTAILSGQRSFDEGPGNDSHGNESPFRKAMSHNVGNCTLIPTELRAARADYTAEYFKLLQDLNHMRLVDNSGSHPLTQQQRAILEEMAFRSANLTYGQLRKKLGISDEVRFAGLYYGEDTIEKAEKRKWPQMQSYHKIRTALDKVSKDAIQTLTQDQLDAIGEILAGGVSDAKRINSFCLAGIPEEYHKALLPLSISKRAKLSIAAMRKLIPFLQQGMRYDEACKAAGLDFHGADGKVEKLSDFLNEITNPVVRRAVSQTIKVVKAVVDTYSNRKEMKLDAVRIELAREMHHSIKERNRMKKRQEENREKNEQVKAQILETKPGTRVTGLDIVKFKLYQEQDGICPYSGKPLLIERLYEPGYAEVDHIIPYSRCFDDSYSNKVLVLAEENQQKGNRTPYEYFGANEQRWHEFSARVRASVRDFKKRQKLLNTSFGEEQGKDFIQRNLNDTQHITRVVYNYLRNNLKFADSAYAKAPVRAVNGAVTAMLRGRWGIEKMRGNGDLHHCKDAVVIAATSDSMIKDLTKYYQEEEQLFMGKTHFVDPATGEVLTRKEFQQRFAPKFPQPWDRFREELEVRLDPTNPKEALMALNLSTYEFDPEEEIPPVFVSHMPKHTVTGAAHKETIRGKTETGTAVKTALTSLKLDKNGEIDGYYNPQTDPRLYQALVERLKKFGGDGAKAFAEPFYKPKRDGTPGPRVDKVKIAEKASLSVPTGRGEADNGEMIRIDVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 1647 - protein, 1127 aa, unidentified
  REGION 1..1127: note = Description of Unknown: uncultivated organism with predicted taxonomy: Clostridiales
  REGION 1..1127: note = MG21-137 effector
MNYRIGLDLGIASVGWAVLEDDYTGKPKRIVKLGARIFDSAENPKDGSSLALNRREARETRRRLRRRNHRIKRTKNLLEKYNIMTTKEIENMYATYKFQFNPYELRVKGLDEKLTNSELSRILISFVKRRGYKSNSKSEETNDKEMGKLLTATKENELLMKEKGYRTVGEMYLKDEKFKMQMPDGRILLKVRNTTDDYKNTPLRKLLLDEIKQILNKQKELNVNITSDFIDEYINIFTSQRNFDDGPGQPSIYAGNQIEKMLGKCTFEKEENRAAKATYTFEYFKLLQDINHIKIEKHIINETGKKEVLKRPLTEDERNIIINLAKAKVTLTYASLRTALNLESNERFNMIHYKATNVFSDDINKEAEKERKFKEFESYHKMRVAMDKTEKNYILKLSTDELDVIGTVLTLYKNDNKRIEKLAQLNLPENIINEMLKLSFSKVGNLSIKAMKKIILYLEKGYTYDKAVNEVYEDFRGVVNTEKKKKIALRDLEQELSNPVVKRSVSQAIKVLNAITRTYGEPDVINVELARELSKNFADRQNIKKNQENNMQSNEKAKEDILKLGKSNPTGQDIVKYKLWKEQDGTCVYSGKHISIEDLFTEAVDVDHIIPYSMCFDDTYKNKVLVLSSENRQKGNRIPYQYMQEKGRDLDEYEIRVNNIIKNYSKKQRLLKQKFTREDANEWKDRNIQDTQYISRLMYNLIKDHVQFSNNENFERKVFTVNGQITSHIRKRLGINKIRENGDEHHAIDAAIIATVSQGMIQRITKYYQYIDGRYEKNSGEYIDIETGEIITKEQYEAENGSNFPEPWPKFRKELDIRTTCKTKARMEECLLTEKIFYDDYDDVKPIFISRMPRRKITGQAHLDTIRGLRKSDEGLKTLTKTELTKLKLDKNGEIERYPESQKQDDKLLYNALVEQLRKFGGNGTEAFKKPFYKPKSDGTPGPLVKKVKLEDKTTLAVELNNGKAIAANGDMIRIDVFKVEGEGYYFVPIYVSDTIKNKLPNKASVASKTYAEWKKMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 1648 - protein, 1100 aa, unidentified
  REGION 1..1100: note = Description of Unknown: uncultivated organism with predicted taxonomy: Clostridiales bacterium 42_27
  REGION 1..1100: note = MG21-138 effector
MSEFHYALGLDIGIGSVGWAVLRNQPNGEPDRIQDLGVRIFDKAEQPKTGASLAAPRGDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1649 - protein, 934 aa, unidentified
  REGION 1..934: note = Description of Unknown: uncultivated organism with predicted taxonomy: Clostridiales
  REGION 1..934: note = MG21-139 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKA

SEQ ID NO: 1650 - protein, 1100 aa, unidentified
  REGION 1..1100: note = Description of Unknown: uncultivated organism with predicted taxonomy: Clostridiales bacterium 42_27
  REGION 1..1100: note = MG21-140 effector
MSEFHYALGLDIGIGSVGWAVLRNQPNGEPDRIQDLGVRIFDKAEQPKTGASLAAPRRDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKFLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYQEQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMLELPQEARRDPFPKPWERFRQELEARLDPIDPRHQIDLLKLETYESDEEIKPVFVSRMPNHKVTGAAHAETIRSSKGGYGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1651 - protein, 1113 aa, unidentified
  REGION 1..1113: note = Description of Unknown: uncultivated organism with predicted taxonomy: Firmicutes
  REGION 1..1113: note = MG21-141 effector
MKKRKKKKKDKKDCHYTLGLDIGIASIGWAVLGNDEEGKPNRIIDLGVRIFDKAEVENTGESLAAPRRDARSARRRLRRHRHRLERIRYLLVQQGVLTQEEMTHLYDKSDMVSPYQLRTEGLDRLLNAQEFSKVLIHLAQRRGYQSNSTAEEAKNEKENGVIKSAILENQQRMERGGYRTIGEMMYRDAAFWETINGIRYHCTRNKAGDYRFTVDRASILLEVSLLFEAQRRLGSPWASQEMEDAYTAILSSQRSFDEGPGGDSPFRKGIADRVGNCTLEPTEQRAAKADVTFERFKLLQDLNHMRLVDNNGSHPLTQQQRDDLEAAAFHTANLTYGQLRKKLGLSEEVRFAGLYYGTDPIEKAEKRKWAQMQSYHKIRMALDKVSKDAILTLTQDQRDAIGEILTAYKADAARIEHLQSAGIPKEYHNALLSLSFSKYGKLSCCAMRKLIPLLQQGMRYDEACREVYQDHRTKEASEKKQRLSLNDIDEITNPVVRRAVSQTIKVVNAVVRIYGNPDAVRIELAREMSHSFDERNKMKKRQEDGRQENEQVKAQILETKAGDRVTGLDIVKFKLYREQDGVCLYSGKGLDLQRLYEPGYADVDHIIPYSRCFDDSYSNKVLVLASENRQKGNCTPYEYFGENEQRWHEFSVRVGASVRDFKKRQKLLNTSFGEEQGKNFIQRNLNDTQHITRVVYNYLRNNLEFADSAYAKAPVQAVNGAVTAMLRGRWGIEKMRGDGDLHHCKDAVVIAATSPSMIQRLSNYYKEEERLFMGKTHFVDPGTGEVLTRKEFQQRFAPQFPQPWPRFREELEARLDPVNPTEALMALHLSTYEPEEEIKPVFVSHMPKRTVTGAAHEETIRSRTETGTVTKTALTALKLDKNGEIDGYYSPQTDPRLYRALVERLKQFGGEGTKAFAEPFYKPKKDGTPGPRVDKVKIERKSSLSVPTARGVAKNGDMIRMDVFRVPNERKSDDSYYFVPIYVADTKKATLPSKAVVKGKAPEAWKQMKPEHFLFSVFKGDLIYVESKKGISLALAKEAVGEKIIQVKSGLFYFCGADISDGSIKIETHDGRYYKKSLGIKELKAFEKRQVDVLGNVSKVRLPETRLEFRGRK

SEQ ID NO: 1652 - protein, 1061 aa, unidentified
  REGION 1..1061: note = Description of Unknown: uncultivated organism with predicted taxonomy: Clostridiales bacterium 42_27
  REGION 1..1061: note = MG21-142 effector
NYALLYQLDLNEWVWRKERDARSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYRDERFWQKHPDGTRYHQTRNKAEDYRFTVERAAIVDEVRQIFAAQRRLGTAWMDEYMETAYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKMRTALDKVGKGAIGTLTEEQLNAVATILTECKSDAKRIAALREAGIPPQFDEALLPLSFSKYGSLSVQAMQKLIPLLEEGLRYDEACTRVYGDHRGLHPEQRKNRLSLTDMDEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESSGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGEMIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFAQPFYKPKKDGSPGPRVDKVKICEKATVGLPVRDGIAANGSMVRIDVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 1653 - protein, 1040 aa, unidentified
  REGION 1..1040: note = Description of Unknown: uncultivated organism with predicted taxonomy: Clostridiales bacterium 42_27
  REGION 1..1040: note = MG21-143 effector
RSARRRLRRHRHRLERIRYLMEQRGIMPVADIQAMYAAGGFQKSPYQLRAEALDRPLTKEEAVRVLIHLAQRRGYKSNSTAEAAKDEKETGKVKTAIEENRRCMAEHGYRTVGEMMYWDERFWQKHPDGTRYHQTRNKAEDYRFTVERAAIVDEVRQIFAAQRRLGTVWMDEDMETDYLSILESQRSFDEGPGGDSPFSGGIGERVGACTFEPDEKRAAKATYTFEYFKLLQDLSRMRLTGMGMPPEPLDAAQREVLKSAALRSASLSYGQIRKKLNLDDDVFFHGLYYGEKTKEEAEKRKWPQMQSYHKLRTALDKVGKGAIGTLTEEQLNAVATILTECKSDAKRIAALREAGIPPQFDEALLPLSFSKYGSLSVRAMQKLIPLLEEGLRYDEACTRVYGDHRGLRPEQRKNRLSLTDMEEITNPVVRRAVSQTIKVINAVVRTYGPPDVVRIELAREMSRTFDERRKMEKRQDDNRAANERAKDQIAEYKGDHATGLDIVKFKLYREQDGVCLYSGQNLDIARLFEPGYADVDHIIPYSRCFDDSYQNKVLVLASENRQKGNRLPYEYFGQDEARWHGYEVRVENLIHNYRKRQKLLKRRLTEEESTGFIDRNLKDTQYITRAVYNLIRDHLAFAESNYRKKPVQAVNGAVTAMLRGRWGVQKIREDGDLHHCLDAAVIAATTPGLVQRLTAYNKHRETWERSPAGYVDPATGELIELPQEARRDPFPKPWERFRQELEARLDPIDPRHQIDLLKLETYESDEEIKPVFVSRMPNHKVTGAAHAETIRSSKGGDGFTVTKTPLTNLKLNKFGEIEGYYNPASDTLLYDALLARLKDFGGDGAKAFVQPFYKPKKDGSPGPRVDKVKICEKATVGLPVRDGIAANGSMVRIDVFYVEDDGYYFVPIYVADTKKESLPNKAVVAYKAYSEWKEMKDENFIFSLYPGDLVRIQSRKGIKLNLAKGGTGEKEIVRQEGMYYYRASGITVGAIQIETHDRRYLQPSLGIKTLQSIEKYQVDVLGNYYKVDLPEKRMTFSKEG

SEQ ID NO: 1654 - protein, 1098 aa, unidentified
  REGION 1..1098: note = Description of Unknown: uncultivated organism with predicted taxonomy: Clostridiales
  REGION 1..1098: note = MG21-144 effector
LSLRYTLGLDIGIASVGWAVLENNIDGEPIKIERLGVRIFDKAEQPKTGASLAEPRREARGQRRTIRRRRHRKDRIKQLIQQNGIMTRVEMAEMFEHLQFETSVYELRVQALERALTKQEFVRVLIHLAQRRGYKSNSKSEEAKDKENGKVKSAISENKKCMEENGYRTIGEMLLNDDRFWECNPDGIKIFVPHNHPDDYRTTVERSMVEDEIQLIFSRQRALGVPYATSEFEEAYLEIWGSQRNFDEGPGGKSPYGGNMIEKMLGHCTFEKDEPRAAKGSYSAEYFRLLQDVNHLRLVKNNGESCALTREQKQIYIDLVMKSAAASYAQLRKKLELSNDISFNMLRYGSDEIGKVERKKLGHMKFYHEMRKALNTVQKDAISTVSWEQRDEIARILLCYKSDDKRKAQLEKLDIPREFIPALLTLSTSKTAHLSVKALRKLIPYLEKGMTYAEACKEVYGEQKSSITKKNKLSLFDIEPINNPVVRRAVSQTIRVINAVVREYGAPEVVRVELAREMGKPYDVRTQMTKKQEANAKRNEELRQQIKKIKGAEPTGQDIVKFKLFQDQNGVCLYSGQNLDITRLFEAGYVDVDHIIPYSISFDDSYTNKVLVRSPENRQKGNRIPADYFKSDPARWKRFETLVNTQVHNWKKKRNLLTQVLSEEQKNGFKQRNLVDTQYIARVIYNLINDHLQFAETGKYDKKRRTQAVNGAITAHVRKRLGIQKIREDGDLHHAVDAAVVACVSPGMIQKITQYTKHRECIRKTKEGYLDTETGELMTREAYDAKYSPRFPAPWERFRQELEARLSDNPAEEIARLHLATYDSEEEIKQVFVSRKQTHKISGAAHEATIRSAKKPGGSISKKPLTSLSLNKKTGEIKDYYAPESDRLLYEALKKRLEEFDGNAEKAFAEPFYKPKHDGTRGPLVKKVKIYEKKTITVPVGGGNADNGSMIRVDVFYMEDDGYYYVPIYTADVIKDELPNKAVVQKKLPEDWKEMDDKDFLFSMYPNELLYIEHRKGIKLKTKKGSSRQEQIVRKAGFYYFKGLNIAANALFIITHDNGYEQPSLGGKTLSCLKKYTVDALGNYSEVSLPEKRKPLRG

SEQ ID NO: 1655 - protein, 1096 aa, unidentified
  REGION 1..1096: note = Description of Unknown: uncultivated organism with predicted taxonomy: Clostridiales
  REGION 1..1096: note = MG21-145 effector
MEGFRYSLGLDIGIASVGFAVIQNDRNGEPIKIERLGVRVFDRAEQPKTGASLALPRRQARGSRRVIRRRRHRKERIKWLIEDSGLMSRPEQDALLGSGAFDKSVYELRVDALDRRLADDEAVRLLIHFAQRRGYKSNSKAEEAKEAAESGKVKSAISANRQRMEENGYRTVGEMLWRDPLFKRTEPDGRQILVVHNQPGEYKVTVERSMLLEELALIFVRQRELGAPWASEQFEVAYTDIWSSQRNFDDGPGGDSPYGGSQISRMLGKCIFEKELDRAPRASFSAEYFRLLQTANNLKIVGRGQPSEFLDEEQRKLFVELAFSSAAATYTQLRKKLDLPDDLYFNHLYYGEKSKEEIEKKKLGMLPFYHRLRTALNKVEKGAIDQLTAAQRDDIAMILLLYKSDDNRTLRLRDAGIPEEYIPAILELSTAKAAHLSLKAMRKLLPYLEQGYTYDKACKEVYGSHDGKKETERTGRLRLDMTDEITNPVVRRAVSQSIKVINAVVRVYGPPETVRIELARELGKTFDERSKQEKRINENAARNEQAREQIREYKSGDSTGLDIVKFKLFQEQNGVCLYSGKNLDISRLFEAGYVDVDHIIPYSISFDDSYSNKVLVLAGENRQKGNRIPYQYFGNDRERWNRFETLVGTQIRSFKKRKNLLIRSLGEAQIEGFRQRNLVDTQYLSRVIFRLIDENMAFAETGNYKRKTQTVSGAITAQVRKRLGIDKIRENGDLHHAADAAVIACISPGMVHKVTNYAKRCELYRDGQGYIDYETGEVMTKEAFDEKYAPRFPEPWPMFRKELEARLSADPRAEIEHLNLPAYDSSDELRPVFVSRMPRHKVTGAAHMETVRSGKLEGKTVTKTALTDLKLVKGEIKGYYRPEDDPLLYDALKARLQAFGGDAKKAFAEPFHKPKHDGAPGPLVKKVKIMDASSLNVPVNGGIAANGSMVRVDVFRVEDDGYYFVPVYVSDTIRTRLPDRAVVANKPYSEWKVMRDEDFVFSLFPGDLIRIKNSRRIKLNAAKGSTGEPVKYVKDALFYFSGLNISTGALGIQLHDRSYGQTGLGGKTLSLIEKYQVDVLGNYAPVHLPEKRMGFR

SEQ ID NO: 1656 - protein, 1521 aa, unidentified
  REGION 1..1521: note = Description of Unknown: uncultivated organism with predicted taxonomy: Bacteroidales
  REGION 1..1521: note = MG22-1 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDRTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVTKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEEFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1657 - protein, 1542 aa, unidentified
  REGION 1..1542: note = Description of Unknown: uncultivated organism with predicted taxonomy: Bacteroidales
  REGION 1..1542: note = MG22-3 effector
MKNILGLDLGTNSIGWAWIQSKVPQQTDDCPSSSEYLMPDCATIRMAGSRVLPMDGKMLSGFESGLAVSKTKERTTYRMARRVNERFQLRRERLNRVLRILGFLPAHYEACLDRYGKIDEEKNVTIPWVPTADGKRKFLFYASFLEMKERFHEHHPNLEKIPLDWTLYYLRTKALQQAITKEELAWVLHSFNQKRGYNQSRDEVKDEDASQKEEYVKVKVVSVVDSGEKKKGKTSYIVTTESNLQFTTENAAAPSWLDKEREFIVTTKLNPTGLPKMNQEGRIDCTVRIPKEEDWELKKKRTEALIADSHMTVGEYIFHSLLDNPDAKIKGAKVGTIDRHFYKEELIAILKKQAAFHPELKDAERYAECVSALYASNEMHRNILSAWDMPRLIVNDIIFYQRPLKSKKSDIAECPFESRYFMDKEKKLQKQGIKCIPTSHPHFQEYRIWQFLSNLRVLRREVRENGRYMTDVDVSAHYLTDKVKVELYEWLAGKANVKQKELLSKLRMSEKEFRWNYVEDNIYPCGETRSLLSTRLKKAKLPLSLLDSPSSDGSHTFEFELWHILYSVSDLAELRKALRRFARKHDFTAEQQEAFVETFVKCPPFKKDYGAYSDKALVKLLSLMRIGKYWNADRIDTNTRRRIACLLDGEACDSISLRTREKVAERGLQQSIEQFQGLPQSLACYVVYDRHAEASEVVRWESPADLQQFTRQFKQYSLRNPIVEQVVLETLRVVHDLWEEIQKDGGTIDEIHLEMGRDLKNTAEQRARIMRRNRENEMTNFRIKLLLQELHDCQPDIEGIRPYSPSQQELLRLYEETVWESESGKLGGKEASKDIPDDIKKIRDLLSKPSDKPIPQSAIQRYRLWLDQKYLSPYTGRPIPLARLFTADYEIEHIIPRSIFFDDSYANKVICESAVNKLKNNRLGMQFIREMDGRVETVKLGEGRETSILSVDGYVDLVNDLFRNNPRKRNNLLAEEITEDFCHRQLSDTRYIARYIKGILSNIVRQRAADGTLEQEATSKNLIVCTGQITDRVKQDWGLNDVWNHIITPRFERLNRMTGSNDYGEWCCKEGKRYFQTRVPLHLQIGFNKKRIDHRHHAMDAIAIACVNRNVVNYLNNAAAHATDRMDLRMRICRPSGNGQTKKEIRSPWKNFAHDAECALQAITVSFKQNVRIITKATNTYEGYDASGKKVRRCQTSSDHYSIRKPLHKDTVYGEVVLPVVNQVPLKKALLRVNRIVNGKLRKKIQEMQSSGLTDKQIVDFFMKTCADSPEWNSINFKKIEVRAYSNEEGQTRMAAIRTAIDESFSEKVIGSITDVSIQRILLNHLRECNGDSEEAFSPEGIETMNRNIVRLNGGKPHLPIYKVRLGEAMGKKFAVGQRGNKGKKFVITAKNTNLFFAVYANDEGKRSFETIDLHCALEMQKQGSSVAPPINENGDKLLFVLSPNDLVYVPSESELQHDIDSEDLKLDHVFKVVSFSENRCCFVPHSMSSPIAAGFEFNSPNKIEVVSRLGLFEQDKETVSIKNICLPIKMDRLGHLHLVKI

SEQ ID NO: 1658 - protein, 1542 aa, unidentified; identical to SEQ ID NO: 1657
  REGION 1..1542: note = Description of Unknown: uncultivated organism with predicted taxonomy: Bacteroidales
  REGION 1..1542: note = MG22-4 effector

SEQ ID NO: 1659 - protein, 1521 aa, unidentified
  REGION 1..1521: note = Description of Unknown: uncultivated organism with predicted taxonomy: Bacteroidales
  REGION 1..1521: note = MG22-5 effector
MTKSTRNIIGLDLGTNSIGWSWIQQLISPTPTQPSEYIFDGTPIIRMSGSRIIPMPGDVTGSFERGETISKTKDRTANRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKIGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIIDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKDKIFELRKLYNYSNKQIEEHLTKVCINRPEWKNYDFKKIAVRILSNDADATHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADSKGKRSFNMIDLRTAIECRKQGLSVAPSINEKGEKLLFTLSPNDLVYMPSEEEEANGFSIKGNLIKEHIYKMVSATNRQCFFIPHTVADFISRGQEYNVLNKIELAEDGRSIKEHCVPIKVNRLGK

SEQ ID NO: 1660 - protein, 1467 aa, unidentified
  REGION 1..1467: note = Description of Unknown: uncultivated organism with predicted taxonomy: Bacteroidales
  REGION 1..1467: note = MG22-6 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEEIIVTTSLDTSGKPKLDKEGKIIQSAKTPDEKDRTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1661 - protein, 1521 aa, unidentified; identical to SEQ ID NO: 1659
  REGION 1..1521: note = Description of Unknown: uncultivated organism with predicted taxonomy: Prevotella
  REGION 1..1521: note = MG22-7 effector

SEQ ID NO: 1662 - protein, 1521 aa, unidentified
  REGION 1..1521: note = Description of Unknown: uncultivated organism with predicted taxonomy: Bacteroidales
  REGION 1..1521: note = MG22-8 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAERDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSDIDVRVREKVAKAELCESIGQYQGLQQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWLQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEDFSHRQLNDTRYIARFMKGILSNIVRKKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1663 - protein, 1524 aa, unidentified
  REGION 1..1524: note = Description of Unknown: uncultivated organism with predicted taxonomy: Bacteroidales
  REGION 1..1524: note = MG22-9 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGNIIQSVKAPEEKDWTLKKIRTENHIDKSKLTVGEYILQTLLEKPNTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPENQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVHDLWAEIQKEGQTIDEIHLEMGRDLKNTAEERSRIFRRNSENEDTNFRIKLLLEEFYTNEEDMEGIRPYSPSQQELLRIYEEGVWQQEKEIPQDIKDIKKKLSSDKDINEITHSDVQRYRIWMDQKYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGFLSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYTVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1664 - protein, 1521 aa, unidentified
  REGION 1..1521: note = Description of Unknown: uncultivated organism with predicted taxonomy: Bacteroidales
  REGION 1..1521: note = MG22-10 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKECQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKADRILDKRLKDIIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNDLNKEQIYKMVSATNNRCFFIPHTVADFISRGQEYNSVNKIELTEDGRSIKEHCVPLKVNRLGK

SEQ ID NO: 1665 - protein, 933 aa, unidentified
  REGION 1..933: note = Description of Unknown: uncultivated organism with predicted taxonomy: Prevotella
  REGION 1..933: note = MG22-11 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVL

SEQ ID NO: 1666 - protein, 1102 aa, unidentified
  REGION 1..1102: note = Description of Unknown: uncultivated organism with predicted taxonomy: Prevotella sp. MGM2
  REGION 1..1102: note = MG22-12 effector
LYSSHHVAANSTYPFKTGHNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELNNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYF

SEQ ID NO: 1667 - protein, 1558 aa, unidentified
  REGION 1..1558: note = Description of Unknown: uncultivated organism with predicted taxonomy: Prevotella
  REGION 1..1558: note = MG22-13 effector
LYSSHHVAANSTYPFKTGQNRTPLNPFTTHKTQPYNIMTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHEELRDKSLYEQCIKALYAQNEVRRNIIAPWSMSDLLIKDILFYHRPLKSKKSQISECPLEFHCYTDKDGETHRQGIKCIPVSHPLFQEYRIWQFISNLRIYEREHFDNGKHFTNVDKTSDFLTSEKKEELYEWLAEKDSVSQKTLLGHLGLKVERYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLSLQKGFNKKRIDHRHHAMDAIAIACVNRSIVNYLNNAAANQTEREDLRRAVCIPERNGQTKRQLRSPWLCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECKKQGLSVAPSVNEKGDKLLFTLSPNDLVYMPSEEEEANGFSIKGNLIKEHIYKMVSANDNRCFFIPHTVVDFISNGEEYNRHNKIELTEDRRSIKEHCVPLKVNRLGK

SEQ ID NO: 1668 - protein, 781 aa, unidentified
  REGION 1..781: note = Description of Unknown: uncultivated organism with predicted taxonomy: Bacteroides ndongoniae
  REGION 1..781: note = MG22-14 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLNKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAERDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTN

SEQ ID NO: 1669 - protein, 822 aa, unidentified
  REGION 1..822: note = Description of Unknown: uncultivated organism with predicted taxonomy: Prevotella sp. MGM2
  REGION 1..822: note = MG22-15 effector
KWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRQKKYVTTAKDTNLFFAVYADSKGKRSYKTIDLRTAIECRKQGLSVAPSVNEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1670 - protein, 1521 aa, unidentified
  REGION 1..1521: note = Description of Unknown: uncultivated organism with predicted taxonomy: Prevotella sp. MGM2
  REGION 1..1521: note = MG22-16 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1671 - protein, 1187 aa, unidentified
  REGION 1..1187: note = Description of Unknown: uncultivated organism with predicted taxonomy: Prevotella
  REGION 1..1187: note = MG22-17 effector
VSTIDRRFYINEINAILKEQEKYHEELRDKSLYEQCIKALYAQNEVRRNIIAPWSMSDMLIKDILFYHRPLKSKKSHISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQFLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGILEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1672 - protein, 1283 aa, unidentified
  REGION 1..1283: note = Description of Unknown: uncultivated organism with predicted taxonomy: Bacteroidales
  REGION 1..1283: note = MG22-18 effector
VTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1673 - protein, 1521 aa, unidentified
  REGION 1..1521: note = Description of Unknown: uncultivated organism with predicted taxonomy: Prevotella
  REGION 1..1521: note = MG22-19 effector
MTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGKYIFHALLKNPETKIKGAHVSTIDRRFYINEINAILKEQEKYHKELRDKSLYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEKLYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRRHQSNREHYAIRKPLHKDSVYGEVILTSIASVNLKKTLLKAERILDKRLKDKIFELRKLYNYSNKQIEEHLTKVCINRPEWKNYDFKKIAVRILSNDADATHIVAIRKPLDETFDKEKIKTITDTGIQKILKNHLSRYANDPKKAFSPEGIEDMNANIASLNGGKQHLPIYKVRVSEKDNGGYFPIGQKGNRQKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1674 - protein, 921 aa, unidentified
  REGION 1..921: note = Description of Unknown: uncultivated organism with predicted taxonomy: Prevotella sp. MGM2
  REGION 1..921: note = MG22-20 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLRVGEYIFHALLKNPETKIKGAHVSTIDRRFYINEINAILKEQEKYHEELRDKSIYEQCTQALYAQNEVRRNIIAPWSMKDLLTKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLIPDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIM

SEQ ID NO: 1675 - protein, 1521 aa, unidentified
  REGION 1..1521: note = Description of Unknown: uncultivated organism with predicted taxonomy: Bacteroidales
  REGION 1..1521: note = MG22-21 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAELCESIEQYQGLPQWLANYVVYNRHSEASEITKWESPDELDKYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTGIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYAKNPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1676 - protein, 1420 aa, unidentified
  REGION 1..1420: note = Description of Unknown: uncultivated organism with predicted taxonomy: Bacteroidales
  REGION 1..1420: note = MG22-22 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRNKSLYEQCTQALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1677 - protein, 1533 aa, unidentified
  REGION 1..1533: note = Description of Unknown: uncultivated organism with predicted taxonomy: Bacteroidales
  REGION 1..1533: note = MG22-23 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1678 - protein, 1521 aa, unidentified
  REGION 1..1521: note = Description of Unknown: uncultivated organism with predicted taxonomy: Bacteroidales
  REGION 1..1521: note = MG22-24 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKIAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLANEITEEFSHRQLNDTRYIARFMKGILSNIVREKNADGTLEPEETSKNLIVCSGRITDRVKQDWGLNDIWNHIITSRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKDKIFELRKLYNYSNKQIEEHLTKVCINCLEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1679 - protein, 821 aa, unidentified
  REGION 1..821: note = Description of Unknown: uncultivated organism with predicted taxonomy: Prevotella sp. MGM2
  REGION 1..821: note = MG22-25 effector
AGLCESIEQYQGLPQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSATNNRCFFIPHTVADFIS

SEQ ID NO: 1680 - protein, 1521 aa, unidentified
  REGION 1..1521: note = Description of Unknown: uncultivated organism with predicted taxonomy: Bacteroidales
  REGION 1..1521: note = MG22-26 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEVFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEDQTIDEIHLEMGRDLKNTAEERSRIFRRNNENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSINEKGDKLLFTLSPNDLVYMPSEWEEANGFAIDNNLNKEQIYKMVSATNNRCFFIPHTVADFISRGEEYNSHNKIELTEDGRSIKEHCVPLKVNRLGK

SEQ ID NO: 1681 - protein, 1200 aa, unidentified
  REGION 1..1200: note = Description of Unknown: uncultivated organism with predicted taxonomy: Prevotella sp. MGM2
  REGION 1..1200: note = MG22-27 effector
LLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1682 - protein, 822 aa, unidentified; identical to SEQ ID NO: 1669
  REGION 1..822: note = Description of Unknown: uncultivated organism with predicted taxonomy: Bacteroidales
  REGION 1..822: note = MG22-28 effector

SEQ ID NO: 1683 - protein, 1521 aa, unidentified
  REGION 1..1521: note = Description of Unknown: uncultivated organism with predicted taxonomy: Bacteroidales
  REGION 1..1521: note = MG22-29 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKELHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHKESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKAERIIDKRLKDKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1684 - protein, 751 aa, unidentified
  REGION 1..751: note = Description of Unknown: uncultivated organism with predicted taxonomy: Prevotella sp. MGM2
  REGION 1..751: note = MG22-30 effector
FRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDIASGKKIRKHQSNREHYAIRKPLHKDSVYGEVILPSIASVNLKKALLKADRILDKRLKEKIFELRKLYNYSNKQIEEHLTKVCINRPEWKNYDFKKIAVRILSNDADATHIVAIRKPLDETFDEDKIKTITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEEEEANGFSIKGNLIKEHIYKMVNASNNRCFFIPHSVADFISKGEEYNALNKIELTEDGRSIKVHCVPLKVNRLGK

SEQ ID NO: 1685 - protein, 1521 aa, unidentified
  REGION 1..1521: note = Description of Unknown: uncultivated organism with predicted taxonomy: Bacteroidales
  REGION 1..1521: note = MG22-31 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTREKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHSPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALLKADRILDKRLKEKIFELRKLYNYSNKQIEEHLTKVCINCLEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFDMIDLRTAIECWKQGVSVAPSMNEKGDKLLFTLSPKDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1686 - protein, 808 aa, unidentified
  REGION 1..808: note = Description of Unknown: uncultivated organism with predicted taxonomy: Bacteroidales
  REGION 1..808: note = MG22-32 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIDCKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRRALKNLSNSK

SEQ ID NO: 1687 - protein, 1521 aa, unidentified; identical to SEQ ID NO: 1685
  REGION 1..1521: note = Description of Unknown: uncultivated organism with predicted taxonomy: Bacteroidales
  REGION 1..1521: note = MG22-33 effector

SEQ ID NO: 1688 - protein, 797 aa, unidentified
  REGION 1..797: note = Description of Unknown: uncultivated organism with predicted taxonomy: Bacteroidales
  REGION 1..797: note = MG22-34 effector
QTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNIFTRHLKACNGDSKIAFSPQGVEEMNQHIAELNNGNAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1689 - protein, 833 aa, unidentified
  REGION 1..833: note = Description of Unknown: uncultivated organism with predicted taxonomy: Parabacteroides sp. An277
  REGION 1..833: note = MG22-35 effector
MPLRETNFQMQGIKCIPVSNPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHSNERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKK

SEQ ID NO: 1690 - protein, 1533 aa, unidentified
  REGION 1..1533: note = Description of Unknown: uncultivated organism with predicted taxonomy: Bacteroidales
  REGION 1..1533: note = MG22-36 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCSETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEVVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEKGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMTFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGANKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHLAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1691 - protein, 1502 aa, unidentified
  REGION 1..1502: note = Description of Unknown: uncultivated organism with predicted taxonomy: Bacteroidales
  REGION 1..1502: note = MG22-37 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESDTTIAWRSKEDGKNEFIFYPSFLEMASIFKEHHPDIQRIPLDWTLYYLRSKALHQAITKEDLSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAVHSLISDEQKECFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDTYNNKVICESAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENVLRQIVVSFKQNLRVATKATNSYECFDTTSGKKIRKHQSNREHYAIRKPLHKDSVYGEVILTSIASVNLKKALLNAERILDKRLKEKIFELRKLYNYSNKQIEEHLTKVCINCPEWKNYDFKKIAVRILSNDADATHIVAIRKPLDETFDEDKIKTITDTGIQKILLNHLRQNDNDPKKAFTTEGIENMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVAEYCIFLYVFLRLCGQIKEH

SEQ ID NO: 1692 - protein, 1521 aa, unidentified
  REGION 1..1521: note = Description of Unknown: uncultivated organism with predicted taxonomy: Prevotella
  REGION 1..1521: note = MG22-38 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRMPLSLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1693 - protein, 1558 aa, unidentified
  REGION 1..1558: note = Description of Unknown: uncultivated organism with predicted taxonomy: Prevotella sp. MGM2
  REGION 1..1558: note = MG22-39 effector
LYSSHHVAANSTYPFKTGHNRTPLNRFTTHKTQPYNIMTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKIIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHFINEDKTSDFLTTKKKEELYEWLAERDSVSQKTLLGKIGLKVEHYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEIIKWESPDELDNYIRSFKQYSLRNPIVEQVSLETLRVVRDLWTELRKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISRGEEYNSHNKIELTEDRRSIKEHCVPLKVNRLGK

SEQ ID NO: 1694 - protein, 1532 aa, unidentified
  REGION 1..1532: note = Description of Unknown: uncultivated organism with predicted taxonomy: Bacteroidales
  REGION 1..1532: note = MG22-40 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASKLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLSESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1695 - protein, 1521 aa, unidentified
  REGION 1..1521: note = Description of Unknown: uncultivated organism with predicted taxonomy: Bacteroidales
  REGION 1..1521: note = MG22-41 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKAWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDIRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALQQIVVSFKQNLRVATKATNSYECFDTASGKKIRKHQSNREHYAIRKALHKDSVYGEVILTSIASVYLKKALLKAERILDKRLKEKIFELRKLYNYSNKQIEEHLTKVCINCPEWKNYDFKKIAVRILSNDADATHIVAIRKPLDETFDKEKIKAITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1696 - protein, 1521 aa, unidentified; identical to SEQ ID NO: 1678
  REGION 1..1521: note = Description of Unknown: uncultivated organism with predicted taxonomy: Prevotella
  REGION 1..1521: note = MG22-42 effector

SEQ ID NO: 1697 - protein, 1423 aa, unidentified
  REGION 1..1423: note = Description of Unknown: uncultivated organism with predicted taxonomy: Bacteroidales
  REGION 1..1423: note = MG22-43 effector
MGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGRTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHLINENKTSEFLTSEKKEELFEWLAEKDSVSQKTLLGHIGLKVEHYHWNFPEEKTYPCGETRHLIQSRLKKANLLKSFCSLVPEKQKKEFELKLWHILYSVSDYNELRKALETFARKTGFTREEQDLFVEFFSSCPPFKKVYGAYSKRAIARLLPLMRLGKYWHEEHIDSATMNRIEHLISGEECNGIDVRVRENIAKFGLNESIEQYQGLPQWLACYVVYNRHSEASEVTKWESPEELDNYIKAFKQYSLRNPIVEQISLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKDVQILKEEEYVELVDKIFGNNTRKRNIMLADEITEEFSHRQLNDTRYIARFMKGILSNIVREKNADGTLESEETSKNLIVCSGRITDRVKQDWGLNDIWNHIITPRFERLNTKTSSDKFGEYVCKEGKRYFQTRVPLNLQKGFNKKRIDHRHHAMDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVANFISRGEEYNRHNKIELTEDRRSIKEHCVPLKVNRLGKKTL

SEQ ID NO: 1698 - protein, 1521 aa, unidentified
  REGION 1..1521: note = Description of Unknown: uncultivated organism with predicted taxonomy: Bacteroidales
  REGION 1..1521: note = MG22-44 effector
MTKNTRNIIGLDLGTNSIGWSWIQQLISPTPTQPSEYLFDGTPIIRMSGSRIIPMHGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKNNGGYFPIGQKGNRPKKFVTTAQDTNLFFAVYADSKGKRSFKTIDLRTAIECKKQGLSVAPSVNEKGDKLLFTLSPNDLVYMPSEEEEANGFAIKGNLIKEHIYKMVNASNNRCFFIPHSVADFISKGEEYNALNKIELTEDGRSIKVHCVPLKVNRLGK

SEQ ID NO: 1699 - protein, 1521 aa, unidentified
  REGION 1..1521: note = Description of Unknown: uncultivated organism with predicted taxonomy: Bacteroidales
  REGION 1..1521: note = MG22-45 effector
MTKNTRNIIGLDLGTNSIGWSWIQQLISPTPTQPSEFLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKMKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFGEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLHIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEEKIKTITDTGIQKILLNHLSRYADDPKKAFSPEGIEDMNANIASLNGGKQHLPIYKVRVSEKDNGGYFPIGQKGNRPKKYVTTAQDTNLFFAVYADSKGKRSYKTIDLRTAIECRKQGLSVAPSINEKGDKLLFTLSPNDLVYMPSEGEEANGFAIDNNLNKEQIYKMVSANNKQCFFIPHTVADFISNGEEYNRHNKIELTEDRRSIKEHCVPLKVNRLGK

SEQ ID NO: 1700 - protein, 1532 aa, unidentified
  REGION 1..1532: note = Description of Unknown: uncultivated organism with predicted taxonomy: Bacteroidales
  REGION 1..1532: note = MG22-46 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCHRQLTDTRYIARFMMGVLSNIVRQNDNGVLESEAISKNLIVCNGKITDRVKQDWGLNDVWNHIVTPRFKRLNQITNSSDFGEWCNKEGKRYFQTRIPLELQKGVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFTKVAVRVWSNDEEGSRMVSVRKAIDESFDMKQIEKVYDPIVRNILTRHLKACNGDSKIAFSPQGVEEMNQHIAELNNGNAHLPIYKVKLGESKGEKFAIGQKGCKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 1701 - protein, 1521 aa, unidentified
  REGION 1..1521: note = Description of Unknown: uncultivated organism with predicted taxonomy: Bacteroidales
  REGION 1..1521: note = MG22-47 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISDCPLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRAFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1702 - protein, 1532 aa, unidentified; identical to SEQ ID NO: 1700
  REGION 1..1532: note = Description of Unknown: uncultivated organism with predicted taxonomy: Bacteroidales
  REGION 1..1532: note = MG22-48 effector

SEQ ID NO: 1703 - protein, 1521 aa, unidentified
  REGION 1..1521: note = Description of Unknown: uncultivated organism with predicted taxonomy: Bacteroidales
  REGION 1..1521: note = MG22-49 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCKSIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFAKDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINRPEWKNYDFKKIAVRILSNDADATHIVAIRKPLDESFDEVKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVNRLGK

SEQ ID NO: 1704 - protein, 1521 aa, unidentified
  REGION 1..1521: note = Description of Unknown: uncultivated organism with predicted taxonomy: Bacteroidales
  REGION 1..1521: note = MG22-50 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGNNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQKEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1705 - protein, 1301 aa, unidentified
  REGION 1..1301: note = Description of Unknown: uncultivated organism with predicted taxonomy: Prevotellaceae
  REGION 1..1301: note = MG22-51 effector
LVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYEDELNAILLKQAEFHPELTNRNLYEACLMALYANNEAHRYNLATQNTCNLITKDIIFYQRPLKSKKSLIAECPFEKRIFCDAEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARRHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1706 - protein, 941 aa, unidentified
  REGION 1..941: note = Description of Unknown: uncultivated organism with predicted taxonomy: Prevotella sp. MGM2
  REGION 1..941: note = MG22-52 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLYNPQNEAFRLSITNRIISYSSFGFRL

SEQ ID NO: 1707 - protein, 1521 aa, unidentified
  REGION 1..1521: note = Description of Unknown: uncultivated organism with predicted taxonomy: Bacteroidales
  REGION 1..1521: note = MG22-53 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEATVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1708 - protein, 1569 aa, unidentified
  REGION 1..1569: note = Description of Unknown: uncultivated organism with predicted taxonomy: Bacteroidales
  REGION 1..1569: note = MG22-54 effector
YGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1709 - protein, 1614 aa, unidentified
  REGION 1..1614: note = Description of Unknown: uncultivated organism with predicted taxonomy: Bacteroidales
  REGION 1..1614: note = MG22-55 effector
TNIFQKAKPFHNKFTTFVNVSIQRAVLEYQVGLYNNSFFKKATRCYGLLTHKQLCVLYSSHHVAANSTYPFKTGHNRTPLNRFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECPLEFHTYTDKNGVTHRQGIKCIPTSHPLFQEYRIWQFIANLRIYERERFDNGKHLINEDKTSDFLTTKKKEELYEWLAEKDSVSQKTLLGHLGLKVERYHWNYPEEKTYPCGETRHLIQSRLKKANLQKAFHSLISEEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLPLWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKGITPNDIQRYRIWMDQKYCSPYTGKTIPLSRLFTTDYEIEHVIPRSRYFDDSYNNKVICEAAVNKDKNNRLGMEYIMAAGGKTIKLGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTKREDLRRAVCIPERNGQTKRQLRSPWPCFARDTENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1710 - protein, 1347 aa, unidentified
  REGION 1..1347: note = Description of Unknown: uncultivated organism with predicted taxonomy: Bacteroidales
  REGION 1..1347: note = MG22-56 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAAIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAERDSVSQKTLLGKIGLKVEDYHWNFPEEKTYPCGETRHLIQSRLKKANLQKTFHSLISDEQKECFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVLDLWAELQKEGQTIDEIHLEMGRDLKNTAEERSRIFKRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWPCFARDTENALRQIVVSFKQNLRVATKATNSYECFDTTSGKKIRKHQSNREHYAIRKPLHKDSVYGEVILTSIASVNLKKALLKAERILDKRLKEKIFELRKLYNYSNKQIEEHLTKVCINRPEWKNYDFKKIAVRILSNDADATHIVAIRKPLDESFDKVKINTITDTGIQKILLNHLSRYADDPKKAFSPEGIEDMNANIASLNGE

SEQ ID NO: 1711 - protein, 1558 aa, unidentified
  REGION 1..1558: note = Description of Unknown: uncultivated organism with predicted taxonomy: Bacteroidales
  REGION 1..1558: note = MG22-57 effector
LYSSHHVAANSTYPFKTGHNRTPLNRFTTHKTQPYNIMTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDSSGKPKLDKEGKIIQSAKTPDEKDWTLIKIRTEATIDDSKLTVGEYIFHALLENPETKIKGAHVSTIDRRFYINEINAILKEQEKYHEELRDKSIYEQCIKALYAQNEVRRNIIAPWSMKDLLTKDILFYHRPFKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSRQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVYIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1712 - protein, 1558 aa, unidentified
  REGION 1..1558: note = Description of Unknown: uncultivated organism with predicted taxonomy: Bacteroidales
  REGION 1..1558: note = MG22-58 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMDRRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGETHRQGIKCIPVSHPLFQEYRIWQFISNLRIYEREHFDNGKHFTNVDKTSEFLTSEKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYNTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 1713 - protein, 1521 aa, unidentified
  REGION 1..1521: note = Description of Unknown: uncultivated organism with predicted taxonomy: Bacteroidales
  REGION 1..1521: note = MG22-59 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPIKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLENTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKKEEYVELVDKIFGNNTRKRNIMLADEITEDFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALQQIVVSFKQNLRVATKATNSYECFDTASGKRIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILKNHLSQNDNDPKKAFTPEGIENMNANIVLLNGGKQHLPIYKVRISEKNNGGYFPIGQKGNRHKKYVTTAQDTNLFFAVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 1714 - protein, 1521 aa, unidentified
  REGION 1..1521: note = Description of Unknown: uncultivated organism with predicted taxonomy: Bacteroidales
  REGION 1..1521: note = MG22-60 effector
MTKNTRNIIGLDLGTNSIGWSWIQQLISPPPTQPSEYLFDGTPIIRMSGSRIIPMPGDVTGSFERGETISKTKDRTAKRMARRMNERFQLRRERLNRVLNIMGFLPGHYVRALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPKTKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTNEKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPGRNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPVYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1715 - protein, 1521 aa, unidentified
  REGION 1..1521: note = Description of Unknown: uncultivated organism with predicted taxonomy: Bacteroidales
  REGION 1..1521: note = MG22-61 effector
MTKNTRNIIGLDLGTNSIGWSWIQQLISPIPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFANGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAHSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILMEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQIEREDLRRAVCIPERNGQTKRQLRSPWHCFARDAENALRQIVVSFKQNLRIATKATNSYECFDTASGKKNRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNGGKQHLPIYKVRVSEKDNGGYFPIGQKGNRPKKYVTTAKDTNLFFAVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 1716 - protein, 1558 aa, unidentified
  REGION 1..1558: note = Description of Unknown: uncultivated organism with predicted taxonomy: Bacteroidales
  REGION 1..1558: note = MG22-62 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1717 - protein, 913 aa, unidentified
  REGION 1..913: note = Description of Unknown: uncultivated organism with predicted taxonomy: Parabacteroides
  REGION 1..913: note = MG22-63 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWYEESIDSTTKNRIEHLISGEECSSIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNN

SEQ ID NO: 1718 - protein, 1450 aa, unidentified
  REGION 1..1450: note = Description of Unknown: uncultivated organism with predicted taxonomy: Prevotella sp. MGM2
  REGION 1..1450: note = MG22-64 effector
MTKNIRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKQTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSRRTRQTLWSRPCRC

SEQ ID NO: 1719 - protein, 1521 aa, unidentified
  REGION 1..1521: note = Description of Unknown: uncultivated organism with predicted taxonomy: Prevotella
  REGION 1..1521: note = MG22-65 effector
MTKNTRNIIGLDLGTNSIGWSWIQQLISPTPTQPSEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLENPETKIKGAYVSTIDRRFYINEINAILKEQEKYHEELRDKSIYEQCIKALYAQNEVRRNIITPWSMKDLLTKDILFYHRPLKSKKSQISECPLEFHCYTDKDGETHRQGIKCIPVSHPLFQEYRIWQFISNLRIYEREHFDNGKHFTNVDKTSDFLTTKKKEELFEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRIREKVAKAGLCESIEQYQGLQQWLANYVVYNRHSEASEIIKWESPDELDNYIRSFKQYSLRNPIVEQVSLETLRVVRDLWTELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIIVSFKQNLRVATKATNSYECFDTASGKKIRKHQSNREHYAIRKPLHKDSVYGEVILTSIASVYLRKALLKAERILDKRLKEKIFELRKLYNYSNKQIEEHLTKVCINCPEWKNYDFKKIAIRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAKDTNLFFAVYADSKGKRSFNMIDLRTAIECRKQGLSVAPSINEKGEKLLFTLSPNDLVYMPSEEEEANGFSIKDNLIKEHIYKMVSATNRQCFFIPHTVADFISRGQEYNVLNKIELAEDGRSIKEHCVPIKVNRLGK

SEQ ID NO: 1720 - protein, 1053 aa, unidentified
  REGION 1..1053: note = Description of Unknown: uncultivated organism with predicted taxonomy: Prevotella sp. MGM2
  REGION 1..1053: note = MG22-66 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLEMLRVVRNLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCS

SEQ ID NO: 1721 - protein, 938 aa, unidentified
  REGION 1..938: note = Description of Unknown: uncultivated organism with predicted taxonomy: Bacteroidales
  REGION 1..938: note = MG22-67 effector
MTKNTRNIIGLDLGTNSIGWSWIQQLISPTPTQASEYIFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETLRQGIKCIPVSHPLFQEYRIWQFISNLRIYEREHFDNGKHFTNVDKTSEFLTSEKKEELYEWLAERDSVSQKTLLGKIGLKVEDYHWNYPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTAKRYHCPVFSPPTTKSNTSFRVHGILTTPIIIRSSAKLPSTKTKTTDWAWNTSWLLEEKRLNSATGKTFKF

SEQ ID NO: 1722 - protein, 1521 aa, unidentified; identical to SEQ ID NO: 1714
  REGION 1..1521: note = Description of Unknown: uncultivated organism with predicted taxonomy: Bacteroidales
  REGION 1..1521: note = MG22-68 effector

SEQ ID NO: 1723 - protein, 1521 aa, unidentified
  REGION 1..1521: note = Description of Unknown: uncultivated organism with predicted taxonomy: Bacteroidales
  REGION 1..1521: note = MG22-69 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEITAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAEKDSVSQKTLLGHLGLKVERYHWNFPEEKTYPCGETRHLIQSRLKKANLQKAFHSLISDEQKECFERGLWHILYSISDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKEGKRYFQTRVPLNLQKGFNKKRIDHRHHAMDAITIACVNRSIVNYLNNAAANQTEREDLRRAVCIPERNGQTKRQLRSPWHCFARDAENALRQIVVSFKQNLRVATKATNSYECFDTASGKKIRKRQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILLNHLSRYADDPKKAFSPEGIEDMNANIASLNGGKQHLPIYKVRVSEKDNGGYFPIGQKGNRSKKYVTTAKDTNLFFAVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 1724 - protein, 1520 aa, unidentified
  REGION 1..1520: note = Description of Unknown: uncultivated organism with predicted taxonomy: Bacteroidales
  REGION 1..1520: note = MG22-70 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDAENALRQIVVSFKQNLRVATKATNSYECFDTASGKKIRKHQSNREHYAIRKPLHKDSVYGEVILPSIASVNLKKALLKAERILDKRLKEKIFELRKLYNYSNKQIEEHLTKVCINCPEWKNYDFKKIAVRILSNDADTTHIVAIRKPLDETFDEEKIKAITDTGIQKILLNHLRQNDNDPKKAFTPEGIENMNANIVLLNGGKQHLPIYKVRISEKNNGGYFPIGQKGNRSQKYVTTAKDTNLFFAVYADQKGKRSFKTIDLRTAIECRKQGVSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1725 - protein, 1225 aa, unidentified
  REGION 1..1225: note = Description of Unknown: uncultivated organism with predicted taxonomy: Bacteroidales
  REGION 1..1225: note = MG22-71 effector
VGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQCIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1726 - protein, 1521 aa, unidentified
  REGION 1..1521: note = Description of Unknown: uncultivated organism with predicted taxonomy: Bacteroidales
  REGION 1..1521: note = MG22-72 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVDYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKTIYEQCIKALYAQNEVRRNIIAPWSMKDLLTKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRSFKQYSLRNPIVEQVSLETLRVVRDLWAELRKEGQTIDEIHLEMGRDLKNTAEERSRIFRRNSENEDTNFRIKLLLEKFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1727 - protein, 1345 aa, unidentified
  REGION 1..1345: note = Description of Unknown: uncultivated organism with predicted taxonomy: Prevotella sp. MGM2
  REGION 1..1345: note = MG22-73 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMKDLLTKDILFYHRPLKSKKSQISECPLEFHCYTDKDGETHRQGIKCIPVSHPLFQEYRIWQFISNLRIYEREHFDNGKHFTNVDKTSEFLTSEKKEELYEWLAERDSVSQKTLLGKIGLKVEDYHWNFPEEKTYPCGETRHLIQSRLKKANLQKAFHSLISDEQKECFERGLWHILYSVSDYNELCKALKTFARKTGFTLEEQLLFVEAFSSCPPFKKDYGAYCKRAITKLLPLMRIGKFWHEESIDTTTKTRIEHLISGEECSGIDVRVREKVAKAGLCESIEQYQGLQQWLANYVVYNRHSEASEIIKWESPDELDNYIRSFKQYSLRNPIVEQVSLETLRVVRDLWAELQKEGQTIDEIHLEMGRDLKNTAEERSKIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFAREAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLN

SEQ ID NO: 1728 - protein, 1283 aa, unidentified; identical to SEQ ID NO: 1672
  REGION 1..1283: note = Description of Unknown: uncultivated organism with predicted taxonomy: Bacteroidales
  REGION 1..1283: note = MG22-74 effector

SEQ ID NO: 1729 - protein, 1524 aa, unidentified
  REGION 1..1524: note = Description of Unknown: uncultivated organism with predicted taxonomy: Bacteroidales
  REGION 1..1524: note = MG22-75 effector
MTKNTRNIIGLDLGTNSIGWSWIQQLISPTPTQPSEYLFDETPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQPRKDITEKEKTKKIEYIKDIVRSVEDTGEKTKGKKAYKVTFDNGFKFISTEAEAPLWVGHTREVIVTTSLDATGAPKRDKEGDIIQSVKAPEEKDWTLKKIRTENHIDKSKLTVGEYILQTLLEKPDTKIKGAHVSTIDRRFYIHEINAILKVQEKYHKELRDKSLYEQCTQALYTQNEVRRNIIAPWSMSDLLIKDILFYHRPLKSKKSQISECPFEFHNYTDKNGASHRQGIKCIPTSHPLFQEYRIWQFIANLRIYERERFDNGKHFINEDKTSDFLTTKKKEELFEWLTEKDSVSQKTLLGHIGLKVEHYHWNFPEEKTYSCGETRHLIQSRLKKANLLKSFCSLVPENQKKEFELKLWHILYSVSDYNELRKALETFARKTGFTREEQDLFVEFFSSCPPFKKIYGAYSKRAIARLLPLMRLGKYWHEEHIDSATMNRIEHLISGEECNGIDVRVRENIAKFGLNQSIEQYQGLPQWLACYVVYNRHSEASEVTKWESPEELDNYIKAFKQYSLRNPIVEQISLETLRVVHDLWAEIQKEGQTIDEIHLEMGRDLKNTAEERARISKRNSENEDTNFRIKLLLKEFYTNEEDMEGIRPYSPSQQELLRIYEEGVWQQEKEIPQDIKDIKKKLSSDKDINEITHSDVQRYRIWMDQEYCSPYTGNPIPLSRLFTPDYEIEHVIPRSRYFDDSYNNKVICEAAVNKDKNNRLGMEYIMEAGGKTIELGNGKNVQVLKEREYVELVNEVFKNNTRKRNILLADEIPEDFSHRQLNDTRYIARFMKGILSNIVREKNADGTLELEETSKNLIVCSGRITDRIKQDWGLNDVWNHIITPRFERLNQKTSSDNFGEYVCKEGKRYFQTRVPLNLQKGFNKKRIDHRHHAIDAIAIACVNRSIVNYLNNAAANQTEREDLRRAVCIPERNGQTKRQLRSPWRNFAKDAENALRQIVVSFKQNLRILTKATNSYECFDTTSGKKIRRHQVNEEHYAVRKPLHEDFVYGEVILSSIASVNFKKALQKANRILDKRLKDKIFELRKLYSYSNKQIEEHLTKVCINTPEWKDYDFKKINIRILSNDEGATHIVAIRKPLDESFDKVKINTITDTGIQKILLNHLSRYAEDPKKAFSLEGIEDMNANITSLNGGKQHLPIYKVRVSEKDNGGYYPIGQKGNRSKKYVTTAKDTNLFFAVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 1730 - protein, 1132 aa, unidentified
  REGION 1..1132: note = Description of Unknown: uncultivated organism with predicted taxonomy: Bacteroidales
  REGION 1..1132: note = MG22-76 effector
MSDLLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGRLGLKVERYHWNFPEEKTYPCGETRHLIQSRLKKANLQKAFHSLISDEQKECFERGLWHILYSISDYNELCKALKTFARKTGFTLEEQSLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGSNTRKRNIMLADEITEDFSHRQLNDTRYIARFMKGILSNIVREKNAEGTLEPEETSKNLIVCSGRITDRVKQDWGLNDIWNHIITPRFERLNKKTSSNDFGEYVCKEGKRYFQTRVPLNLQKGFNKKRIDHRHHAMDAIAIACINRSIVNYLNNAAANQTEREDLRRAVCIPERNGQTKRQLRSPWHCFARDAENALRQIVVSFKQNLRVATKATNSYECFDTASGKKIRKHQSNHEHYAIRKPLHKDSVYGEIILPSIASVNLKKALLKAERILDKRLKEKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKDTNLFFAVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 1731 - protein, 1521 aa, unidentified; identical to SEQ ID NO: 1692
  REGION 1..1521: note = Description of Unknown: uncultivated organism with predicted taxonomy: Prevotella
  REGION 1..1521: note = MG22-77 effector

SEQ ID NO: 1732 - protein, 1420 aa, unidentified; identical to SEQ ID NO: 1676
  REGION 1..1420: note = Description of Unknown: uncultivated organism with predicted taxonomy: Bacteroidales
  REGION 1..1420: note = MG22-78 effector

SEQ ID NO: 1733 - protein, 1521 aa, unidentified
  REGION 1..1521: note = Description of Unknown: uncultivated organism with predicted taxonomy: Bacteroidales
  REGION 1..1521: note = MG22-79 effector
MTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCIKALYAQNEVRRNIIAPWSMSDMLIKDILFYHRPLKSKKSQISECSLEFHTYTDKDGATHRQGIKCIPTSHPLFQEYRIWQFIANLRIYERERFDNGKHFINEDKTSDFLTTKKKEELYEWLAEKDSVSQKTLLGHLGLKVERYHWNFPEEKTYPCGETKHLIQSRLKKANLQKAFHSLISDEQKDCFERGLWHILYSVSDYNELCKALKTFARKTEFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIRKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKEGKRYFQTRVPLNLQKGFNKKRIDHRHHAMDAIAIACVNRSIVNYLNNAAANQTEREDLRRAVCIPERNGQTKRQLRSPWHCFARDTENALRQIVVSFKQNLRITTKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKDNGGYFPIGQKGNRPKKYVTTAQDTNLFFAVYVDSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1734 - protein, 1558 aa, unidentified
  REGION 1..1558: note = Description of Unknown: uncultivated organism with predicted taxonomy: Bacteroidales
  REGION 1..1558: note = MG22-80 effector
LYSSHHVAANSTYPFKTGYNRAPLNPFTTHKTQPYNIMTKNTMNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKKPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELYEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQSLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWTELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDSVKQDWGLNDIWNHIITPRFERLNTKTSSNDFGEYVCKDGKRYFQTRVPLNLQKGFNKKRIDHRHHAMDAIAIACVNRSIVNYLNNAAANPTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDKIKINTITDTGIQKILKNHLSRYADDPKKAFSPEGIEDMNANIASLNGGKQHLPIYKVRVSEKDNGGYFPIGQKGNRPKKYVTTAKDTNLFFAVYADSKGKRSYKTIDLRTAIECRKQGLSVAPSINEKGDKLLFTLSPNDLVYMPSEGEEANGFAIDNNLNKEQIYKMVSANDNRCFFIPHTVADFISNGEEYNRHNKIELTEDRRSIKEHCVPLKVNRLGK

SEQ ID NO: 1735 - protein, 1533 aa, unidentified
  REGION 1..1533: note = Description of Unknown: uncultivated organism with predicted taxonomy: Bacteroidales
  REGION 1..1533: note = MG22-81 effector
MKKKNILGLDLGTNSIGWAWLQQDDTEQTIQTEYLLQNNPTIRMSGSRIIPTSGDVINDFEAGKAVSKTKDRTTFRMTRRMNERFKLRRERLNRVLRILGMLPAHYAQHVDRYGKPDEEKQPKIAWEVAPDGKSNFLFHQSFLEMVKLFGVHQPQLQRIPLDWTLYYLRHKALTQPISKAELAWILHSFNQKRGYNQTRDELTEVNEKEKLEYTNSKVVSVELIEQKKSPLYLVTFENGVAVETSKVDAPQWVGQMRYAIITTKLNDLGQPLHKKDGSIDQKVSLPNDDDWALNKLRTETQIDQSHTTVGNYIFQTLLKNPETKIKGAHVCTIDRRFYENELNAILLKQAEFHPELTNRNLYEACLMALYANNEAHRYNLATQNTCNLITKDIIFYQRPLKSKKSLIAECPFEKRIFCDTEGNVQMQGIKCIPVSHPHFQEYRLWQFLNNLRIFQREVVEDGKFTMNVDVTDKYINENSLTLLFEWLQDKITIKQKELLAKLRLKESDFRWNYVEDKAYPCGETRHVLASRLKKLKGITNDFLAQPSLNGKTTVECELWHILYSVTNLAELRKALYTFARKHNFSVVDAEAFVKVFIACPPFKKDYGAYSDKAICKLLSVMRVGKYWSAENIDSTTLLRIEHLITGEEDEHINERTRKHITEKGLQQSVNQYQGLQQWLACYVVYGRHAEVAEIVRWESPTELEQYINNFKQYSLRNPIVEQVSLETLRVVRDLWQTVAKEGGRIDEIHLEMGRDLKNSAAERAKISNRNKQNEGTNFRIKLLLQEFSQYEKDIEGIRPYSPSQQELLRIYEEGVCEQTEMPKDIAKIRRELSSSSSEKDVKRSDIQRYRLWLDQKYCSPYTGQPIPLARLFTTDYEIEHVIPRSKYFDDSYNNKVICEAAVNKAKSNRLGMAFIQESGGQIIPLGNGRNVQVLNESAYVEFINKTFKHNARKRSLMLADEITEEFCNRQLTDTRYIARFMMGVLSNIVRQNDNGVLESEAISKNLIVCNGKITDRVKQDWGLNDVWNHIVTPRFERLNQITNSSDFGEWCNKEGKRYFQTRIPLELQKRVNKKRIDHRHHAMDAIAIACTTRSLVNYLNNQSAHTKAREDYRQRLCRTDGHGQTKRLLRAPWKDFAKDAESALQQIVVSFKQNTRILTHATNSYECFDAKAGKKIIKRQISQNHYAIRKPLHKDTVYGEVVLPSIKLISLNKALSNPRRIIDKQLRSKILELQQRDKLTKKQVCDFFKKTCANSTEWRNYDFAKVAVRVWSNDEEGSRMVSVRKAVDESFDMKQIEKVYDPIVRNILTRHLKACNGDSKTAFSPQGVEEMNQHIAELNNENAHLPIYKVKLGESKGEKFAIGQKGSKATKFVVTAKDTNLFFAVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 1736 - protein, 1521 aa, unidentified; identical to SEQ ID NO: 1719
  REGION 1..1521: note = Description of Unknown: uncultivated organism with predicted taxonomy: Prevotella
  REGION 1..1521: note = MG22-82 effector

SEQ ID NO: 1737 - protein, 1521 aa, unidentified
  REGION 1..1521: note = Description of Unknown: uncultivated organism with predicted taxonomy: Prevotella
  REGION 1..1521: note = MG22-83 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKNGATHRQGIKCIPTSHPLFQEYRIWQFIANLRIYERERFDNGKHLINEDKTSDFLTTKKKEELFEWLAEKDSVSQKTLLGRLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEIIKWESPDELDNYIRAFKQYSLRNPIVEQVSLETLRVVRDLWAELQKEGQTIDEIHLEMGRDLKNTAEERSRIFRRNSENEDTNFRIKLLLEEFNANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWSHIVTPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILPSIASVNLKKALMKADRILDKRLKEKIFELRKLYNYSNKQIEEHLTKVCINCPEWKNYDFKKIAVRILSNDADATHIVAIRKPLDETFDEDKIKTITDTGIQKILLNHLSRYADDPKKAFSPEGIEDMNANIASLNSGKQHLPIYKVRVSEKDNGGYFPIGQKGNRPKKYVTTAKDTNLFFAVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 1738 - protein, 1558 aa, unidentified
  REGION 1..1558: note = Description of Unknown: uncultivated organism with predicted taxonomy: Bacteroidales
  REGION 1..1558: note = MG22-84 effector
LYSSHHVATNSTYPFKTGHNRTPLNRFTTHKTQPYNIMTKNTRNIIGLDLGTNSIGWSWIQQLISPTSTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSLYEQCTQALYAQNEVRRNIIAPWSMSDLLIKDILFYHRPLKSKKSQISECSLEFHTYTDKDGATHRQGIKCIPTSHPLFQEYRIWQFIANLRIYERERFDNGKHFINEDKTSDFLTTKKKEKLYEWLAEKDSVSQKTLLGHLGLKVERYHWNFPEEKTYPCGETRHLIQSRMKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEDFSHRQLNDTRYIARFMKGILSNIVREKNADGTLEQEETSKNLIVCSGRITDRVKQDWGLNDIWNHIITPRFERLNTKTSSDKFGEYVCKEGKRYFQTRVPLSLQKGFNKKRIDHRHHAMDAIAIACVNRSIVNYLNNAAANQTEREDLRRAVCIPERNGQTKRQLRSPWHCFARDTENALRQIVVSFKQNLRVATKATNSYECFDTASGKKIRKHQSNHEHYAIRKPLHKDSVYGEVILPSIASVNLKKALLKAERILDKRLKEKIFELRKLYNYSNKQIEEHLTKVCINCPEWKNYDFKKIAVRILSNDADATHIVAIRKPLDESFDKVKINTITDTGIQKILLNHLSRYADDPKKAFSPEGIEDMNANIASLNGGKQHLPIYKVRVSEKNNGGYFPIGQKGNRHKKYVTTAQDTNLFFAIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 1739 - protein, 1521 aa, unidentified
  REGION 1..1521: note = Description of Unknown: uncultivated organism with predicted taxonomy: Prevotella
  REGION 1..1521: note = MG22-85 effector
MTKNTRNIIGLDLGTNSIGWSWIQQLISPTPTQPSEYFFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHIINEDKTSDFLTTKKKEELFEWLAEKDSVSQKTLLGHLGLKVERYHWNFPEEKTYPCGETRHLIQSRLKKANLQKAFHSLISDEQKDCFERSLWHILYSVSDYNELCKALKTFARKTGFTLEEQSLFVEAFSSCPPFKKDYGAYSKRAITKLLPLMRIGKFWHEESIDSTTKNRIEHLISGDECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITQRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRIATKATNSYECFDTASGKKIRKHQSNREHYAIRKPLHKDSVYGEVILPSIASVNLKKALLKAERILDKRLKDKIFELRKLYNYSNKQIEEHLTKVCINCPEWKNYDFKKIAVRILSNDADATHIVAIRKPLDETFDKEKIKTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1740 - protein, 985 aa, unidentified
  REGION 1..985: note = Description of Unknown: uncultivated organism with predicted taxonomy: Bacteroidales
  REGION 1..985: note = MG22-86 effector
MKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEETNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAINKDKNNRLGMEYIMAAGGKTIELGNGKDVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAVRILSNDADATHIVAIRKPLDESFDEVKINTITDTGIQKILKNHLSRYADDPKKAFSPEGIEDMNANIASLNGGKQHLPIYKVRVSEKDNGGYFPIGQKGNRSKKYVTTAKDTNLFFAVYANSNGKRCFKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 1741 - protein, 935 aa, unidentified
  REGION 1..935: note = Description of Unknown: uncultivated organism with predicted taxonomy: Prevotella sp. MGM2
  REGION 1..935: note = MG22-87 effector
YQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHKELREKSLYEQCIKALYAQNEVRRNIIAPWSMSDLLIKDILFYHRPLKSKKSQISECPLEFHCYTDKAGETHRQGIKCIPVSHPLFQEYRIWQFISNLRIYEREHFDNGKHFSNVDKTSEFLTSEKKEELYEWLAEKDSVSQKTLLGKIGLKVEDYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKTRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSQRQLNDTRYIARFMKGILSNIVREKNADGTLEPEETSKNLIVCSGRITDRVKQDWGLNDIWNHIVTPRFERLNTKTSSNDFGEYVCKEGKQYFQTRVPLNLQKGFNKKRIDHRHHAMDAIAIACVNRSIVNYLNNAAANQIEREALRRAVCIPERNGQTKR

SEQ ID NO: 1742 - protein, 1521 aa, unidentified
  REGION 1..1521: note = Description of Unknown: uncultivated organism with predicted taxonomy: Prevotella sp. MGM2
  REGION 1..1521: note = MG22-88 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIEKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIARFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1743 - protein, 884 aa, unidentified
  REGION 1..884: note = Description of Unknown: uncultivated organism with predicted taxonomy: Prevotella sp. MGM2
  REGION 1..884: note = MG22-89 effector
LLPLMRIGKFWHEESIDSTTKNRIEHLISGEECSGIDVRVREKVAKAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTIFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLADEITEEFSHRQLNDTRYIARFMKGILSNIVREKNADGTLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRKHQSNREHYAIRKPLHKDSVYGEVILTSIASVNLKKALLKADRILDKRLKEKIFELRKLYNYSNKQIEEHLTKVCINCPEWKNYDFKKIAIRILSNDADATHIVAIRKPLDESFDKVKINTITDTGIQKILLNHLSRYADDPKKAFSPEGIEDMNANIASLNGGKQHLPIYKVRASEKDNGGYFPIGQKGNRPKKYVTTAKDTNLFFAVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNVDNSAKIR

SEQ ID NO: 1744 - protein, 1558 aa, unidentified
  REGION 1..1558: note = Description of Unknown: uncultivated organism with predicted taxonomy: Bacteroidales
  REGION 1..1558: note = MG22-90 effector
LYSSHHVAANSTYPFKTGHNRTPLNRFTTHKTQPYNIMTKNTRNIIGLDLGTNSIGWSWIQQLISPTPTQPSEYLFNGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMASIFKEHHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEAPLWIGRTREIIVTTSLDTSGKPKLDKEGKIIQSAKTPDEKDWTLIKIRTEATIDDSKLTVGEYIFHALLKNPETKIKGAYVSTIDRRFYINEINAILKEQEKYHKELRDKSLYEQCIKALYAQNEVRRNIIAPWSMSDLLIKDILFYHRPLKSKKSQISECPLEFHTYTDKDGATHRQGIKCIPTSHPLFQEYRIWQFIANLRIYERERFDNGKHLINEDKTSDFLTTKKKEDLYEWLAEKDSVSQKTLLGHLGLKVERYHWNFPEEKTYPCGETRHLIQSRLKKANLQKAFHSLISDEQKDCFERGLWHILYSVSDYNELCKALKTFARKTGFTLEEQLLFVEAFSSCPPFKKDYGAYSKRAITKLLPLMRIGKFWHEESIDSTTKNRIEHLISGEECSGIDVRVREKVAKAGLCESIEQYQGLQQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIIAAGGKTIELGNGKNVQILKEEEYVELVDKIFGNNTRKRNIMLADEITEEFSHRQLNDTRYIARFMKGILSNIVREKNTDGTLEPEETSKNLIVCSGRITDRVKQDWGLNDIWNHIITPRFERLNTKTSSNDFGEYVCKDGKRYFQTRVPLNLQKGFNKKRIDHRHHAMDAIAIACVNRSIVNYLNNAAANQTEREDLRRAVCIPERNGQTKRQLRSPWPCFARDTENALRQIVVSFKQNLRIATKATNSYECFDTASGKKIRKHQSNHEHYAIRKPLHKDSVYGEVILTSIASVNLKKALLKAERILDKRLKEKIFELRKLYNYSNKQIEEHLTKVCINCPEWKNYDFKKIAVRILSNDADATHIVAIRKPLDESFDEVKINTITDTGIQKILLNHLSRYADDPKKAFSPEGIEDMNANIASLNGGKQHLPIYKVRVSEKNNGGYFPIGQKGNRPKKYVTTAQDTNLFFAVYADQKGKRSFKTIDLRTAIECRKQGLSVAPSINEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 1745 - protein, 1521 aa, unidentified
  REGION 1..1521: note = Description of Unknown: uncultivated organism with predicted taxonomy: Prevotella
  REGION 1..1521: note = MG22-91 effector
MTKNTRNIIGLDLGTNSIGWSWIQQLISPTPTQPSEYLFDGTPIIRMSGSRIIPMPGDVTGSFERGETISKTKDRTAKRMARRMNERFQLRRERLNRVLNIMGFLPEHYARALDRYGKLNEESNTTIAWRSKEDGKNEFIFYPSFLEMAFIFKERHPDIQRIPLDWTLYYLRSKALHQAITKEELSWVLHSFNQKRGYYQSREDITEEDKTKKVEYIKGVVNSVEDTGEKAKGKKIYKVTFADGTEFTSTKSEALLWIGRTREIIVTTSLDTSGKPKLDKEGKIIQSAKTPDEKDWTLIKIRTEATIDDSKLTVGEYIFHALLKNPETKIKGAHVSTIDRRFYINEINAILKEQEKYHEELRDKSIYEQCTQALYAQNEVRRNIIAPWSMSDLLIKDILFYHRPLKSKKSQISECPLEFHTYTDKNGATHRQGIKCIPTSHPLFQEYRIWQFIANLRIYERERFDNGKHLINEDKTSDFLTTKKKEELFEWLAEKDSVSQKTLLGHLGLKVERYHWNFPEEKTYPCGETRHLIQSRLKKANLQKAFHSLISDEQKECFERGLWHILYSISDYNELCKALKTFARKTGFKLEEQLLFVEAFSSCPPFKKDYGAYSKRAITKLLPLMRIGKFWHEESIDSTTKNRIEHLISGEECSGIDVRVREKVAEAGLCESIEQYQGLPQWLANYVVYNRHSEASEITKWESPDELDNYIRSFKQYSLRNPIVEQVSLETLRVVRDLWAELQKEGQTIDEIHLEMGRDLKNTAEERSRIFRRNSENEDTNFRIKLLLEEFYANEKDIKDVRPYSPSQQELLRIYEEGVWQQEKDIPQDIKDIKKRISNDKDIKDITPNDIQRYRIWMDQKYCSPYTGKTIPLSRLFTTDYEIEHVIPRSRYFDDSYNNKVICEAAVNKDKNNRLGMEYIMAAGGKTIELGNGKNVQILKEEEYVELVDKIFGNNTRKRNIMLTDEITEEFSHRQLNDTRYIVRFMKGILSNIVRGKNADGKLEPEETSKNLIVCSGRITDRVKQDWGLNDIWNHIITPRFERLNKKTSSNDFGEYVCKDGKRYFQTRVPLNLQKGFNKKRIDHRHHAMDAIAIACVNRSIVNYLNNAAANQTEREDLRRAVCIPERNGQTKRQLRSPWHCFARDAENALRQIVVSFKQNLRVATKATNSYECFDTASGKKIRRHQSNREHYAIRKPLHKDSVYGEVILPSIASVNLKKALLKADRILDKRLKDKIFELRKLYNYSNKQIEEHLTKVCINCLEWKNYDFKKIAVRILSNDADATHIVAIRKPLDESFDKVKINTITDTGIQKILLNHLSRYADDPKKAFSPEGIEDMNANIASLNGGKQHLPIYKVRVSEKDNGGYFPIGQKGNRSKKYVTTAKETNLFFAVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 1746 - protein, 1558 aa, unidentified; identical to SEQ ID NO: 1667
  REGION 1..1558: note = Description of Unknown: uncultivated organism with predicted taxonomy: Bacteroidales
  REGION 1..1558: note = MG22-92 effector

SEQ ID NO: 1747 - protein, 750 aa, unidentified
  REGION 1..750: note = Description of Unknown: uncultivated organism with predicted taxonomy: Bacteroides
  REGION 1..750: note = MG22-93 effector
LGPNSIGWAVVEREEKSSDNSSLFTGGKILMAGSRIIPMSADILNNYEKGVSVSQTSERTKYRQVRRQYERFHQRRERLNRVLQELGFLPAHYSEQLDRYGKLPKGKEPKIAWRPTADGKYEFIFRSSFLEMMAEIRKSHPECKQIPYDWTLYYLRKKALYEKLTPEELSWVLHSFNQKRGYNAVRGQVEEDTETPDKLQEYRKSCLIGLEDTGEKTRGTNVYKLSFEDGTVFEMPLRKINFAVGDEVEFFITTRLDEDGTPKLNKQGLPVISYKIPNADDAWTLNKLRAEFTIDQSCSTVGQYIYDAILRNPQQKIRGELVRTVDRRFYRDELNRILDKQISLHPILQDDNKLQECLLALYPSNEAHRCTMSGRGFKALFMDDVILYQRPLKSKKSLIDACKYEFHTYINKDGKHEKSVLRCASRSNPLFQEFRLWQFIENLRIYKRKDLSDGHLLTDVDVTGKYLSDEDVRVALFDWMRDRSDVDQKSLLKYFKLSESDFRWNYVEDRKYPASETRAEMLKRLKKAGVPTDFLNLENEMALWEIFYSINEKKELEKALSSFARKHNFEVEKFIQSFRTIKPYPSDYCAYSTKALRRLLPLMRQGKYWKEEEIDDQTRSRIQRLIDGEWDEGIAEKVREKTVSLRCESDFRGLPVWLASYVVYNRHSEASEIKKWESPEEMDADIRKFRQHSLRNPIVEQVCLETLRVVRDIWKEEGISMKSTWRWDVKCGLQQRNAKRVAAYKWKTSR

SEQ ID NO: 1748 - protein, 1496 aa, unidentified
  REGION 1..1496: note = Description of Unknown: uncultivated organism with predicted taxonomy: Prevotella
  REGION 1..1496: note = MG22-94 effector
MKNILGLDLGPNSIGWAVVQTEKEGAEESLFAQGKILMAGSRIIPMDASTLGDFEKGNSTSQTADRTKFRQVRRQYERFHQRRERLNRVLLTLDYLPEHYAKELDRYGKLPKEGEPKLAWRPTPDGAYEFLFRDAFLEMVSEFKKHHPELKQIPYDWTIYYLRKKALRQALTPHELSWVLHSFNQKRGYNAVRGKEDKETESPDKRQEYHKSVLTSISDTGEKLRGNVVYRLAFSDGATFDVAGRHISLSEGEEVEYIKTTKLDEDGMPKLTRQGVPDVSYKIPNADDAWTLNKLRAEFTIEQSGTTVGEYIYDAILRNPGQKIRGELVRTIDRRFYRDELCRILDTQIPLHPVLQDGNKLEECLQTLYPNNEAHRLSMLGRGFKGLFMDDVILYQRPLKSKKSLIDDCKYESRTYVNQDGARVRVGLKCASRSHPLFQEYRLWQFMENLRILKRKEFVDGHLRTNVDVTGHHLPDENSRVALFDWLYGRATVDQKALLKYLHLSEEEYSWNYVEERDYPAAETRAEMQKRLKKAGISADFLTPEREMALWEILYSVGVQGELEKALRRFASKHGVDADKFCQSFRTIKPYPADYCAYSTKALRRLLPLMRQGRYWSLSAIDPQTRQRMQRLIDGEWDEGISDRVREKTSDLRHETDFRGLTSWMATYVVYNRHSEAADIKKWHTPEEMDADIRRFRQHSLRNPIVEQVCLEALRTVRDIWKEIGKIDEIHVEMGRNMRATAKERQKTSQLQLENEQANLRIKALLQEFMNPEFEVEDVRPYSPSQQELLRIYEGTVLEQEAGHIDEPIREIIRKFSQTDAAKRPTTSEVLRYKLWLEQKYRSPYTGEVIPLGKLFTPAYQIEHVIPQSLYYDNSFNNKVICEAEVNLLKGNQLGMPFIMRHANEKVVCSMGKQVKIFTPEAYRLFVEEHYRGRKMTILLSEEIPTAFNDRQKNDTRYISRYIIGELSKLVREEKPDGTLEQEPTSKNVVVLNGSVTDKLKKDWGLVDVWNEIITPRFRRLNEMEGSQRFGQDAEKGGKRYFQITMPLELQRGFQRKRIDHRHHAMDAITIACATRQVINYLNNDHSHAGQGREDLHRAVCRKRGSEWFIRKPWDTFTQDAHARLNQIVISFKQNLRVINKTGNHYWRYNPKTGKKEIFHQQKGDSWAIRQALHKESVFGRVNLRTTKFVSFKEAFASLERIVDKRLKRAILAGMARYSGHCTDKQMLIYLQEQQEWKSFDFKKVAVYTFSEDDDKSRMCAIRKRLDDSFDKKKILSVTDTGIQRILLRHLEQSGGNPKDAFSPEGIVRMNETIQELNGGKPHQPILSVRITETMGNKFAVGMRGNRGKKFVEAAKGTNLFFATYLQEDGKRLFRSLPLNEVVERQKQGLPVAPERDEQGNSLLFVLSPGDLVYLPTSDEQEGRVEPAALDLSRIYKMVSCTRSQCLFVPHRVASVIKDKYEYSSMNKMERAITGEMIKESCLPLEVDRLGRYRIK

SEQ ID NO: 1749 - protein, 1381 aa, unidentified
  REGION 1..1381: note = Description of Unknown: uncultivated organism with predicted taxonomy: Bacteroidales
  REGION 1..1381: note = MG22-95 effector
EADADEEKKKKEVKTLEKATVVSIEQSDAAKGGRYWWNYHLSNGMIYKRTSERPMEWLGTERYFIVTTKLDADGNPKKRKDGTTDKSISAPSADDWGLMKLKTESEIGESGKQLGEFIYDKILADPTAKIIGGEVTVVDRRFYRDELRAILDKQREYIAALRDRELYAECIEALYPSNAAYRNIIAGKDFSYLLTDDVILYQRPLKSKKYLISDCPYETVTFTDKSGQEVTKRLKCVPRSHPLFQEFRVWQFIANLRIYQKERVEGGRKLIDADVTDLLLKNDADRVALFEWLNARADVVQDDLLKFLVAEARKRPISEQSADFGELLVMAHGAKAKKDKAYTAFKWNYVEDKKYPCNKTHSVILSKLSSEEEREALTPEIEEMIWHALYSITDKREFDKAFSPNARHPERGLYATLSRHFSPESIGGIKSIILKESDYGSYSRRALSRLLPLMRCGALWSAEAIDTATRARIDKIIDGEWDEGIDTRTRNLMAGMSTVEQFRGMATWQACYVVYGRHSEASEVMRWNSPDDLRAFITSFPHNSLRNPTVERIILETLRIVEEIWRHYGHIDEIHVELARSVKQNKEQRERAMTQMAENERRNLRLRAMLEAFLNDRDPIGFDPDANINPGSPNQQLKLRLFEDTAFSYAQANGDDQVEEMLNIRNSITGGSDEKSATPAQIRRYALWLEQNFRSPYTGATISLARLFTDDYQVDHIIPQALYWDDSFNNKVLCEGGVNNTKSNALAFDFIAAHQGETIALPNGRKVTILSMEQYQELVLATYKNNRAKCEKLLMKEIPAEFTQRQLNDTRYISKVVKSLLSNVVRERDEEGNLEAEAISKNVIVPVGAMTDRLKQDWGLKDVWNQLMLPRFRALNDKMAPYRFTKITRRGHEIPAMPLELVKGFSKKRIDHRHHAMDAIAIACTTRRHIQYINGDAGEAEADKSKYIDKQRVIDARRTIRNKIAHRLDGDGKPIFDKPWTTFTEDVKRALENLIVSFKQTNKVISHTSNKSQRYVDGQKRFVRQTKGEQIAIRKPLHKETVSALVNLREVKEVTLKEAVATVPTIVDKELRAKIVELIAKGYDEKRMKAYFEEHNDEWTDVNPARKKVKVYRFSEESGSNHYYATRVALDTTFDAKKIRTITDTGIQKILLRYLEAKGSAAVAFTPEGIDELNANIARYNGGRQHQPIVKVRTYVNGDRYAIGTVGNKSKKYVVAQSGTLLYYFAFAHTEYDKKRKEEVTLRVFSAIPLRDVIAAMKADRDNWEDCVTASLKERGIIPADARFLFKLSPGDMIYLPDAHETIAPSAIDRAKVYKVVSFFGDNGGYLFVVPYSVAKPIIDKIEYGTQNKVNLAGELKQRIIPLAVDRLGNITWVYDPAGEK

SEQ ID NO: 1750 - protein, 890 aa, unidentified
  REGION 1..890: note = Description of Unknown: uncultivated organism with predicted taxonomy: Bacteroidales
  REGION 1..890: note = MG22-96 effector
MRVGKYWTADNIDPTTLHRIQLLISGEDDGELNLRTRDKLENLRNIEDFQGLPVWMACYVVYGRHSESGNIQKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQLELLRIFEEGILDDSAGNMPDDIQEIIKKLDSTDIKRRPTESEVLRYRNWLEQGYRSPYTNEIIPLSKLFTTAYQIEHIIPQSLYFNNSYNNKVICEAEVNQLKSNQLGMEFVKNHGGEIVECAFGRKVRILTPEEYTAFVEQHYKHNVHKKNNLLSTELPSEFSSRQLNDSRYISKLMIGLLSNIVREETDGHLEEEAISKNLIVCTGKVTERLKQDWGLKDVWNEIIRPRFERLNQMEQTERFGHWENKQGKNVFQITIPIELSSSVDRKRIDHRHHAMDAITIACATRNMVNYLSNQASGKTRFDLQHALCIKQKMDAQGNYKWLIRKPWQTFTEDAKTALNEIVVSFKQNLRVINKTSNHYETIGSDGKKILRRQSKGDSWAIRKSMHKDTVFGNVNLRSIKQVTLKQALQQVDRICSKELKKYILSLQKLHFSGKGIEAQLKEKGRRLFPDIDLKKIDIYYFSNDSENTRMVASRKPLDNSFNQKAIEAITDSGIRKILLNHLEQCNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPSDTVYVPTPDEMETGNIDLNYIDKGRLYKMVSCSGRQCFFLPIEIACMIWDKVEFSATNKMERSITGEMIKDICIPIKCNRLGELLP

SEQ ID NO: 1751 - protein, 1490 aa, unidentified
  REGION 1..1490: note = Description of Unknown: uncultivated organism with predicted taxonomy: Bacteroidetes
  REGION 1..1490: note = MG22-97 effector
MKRVLGLDLGTNSIGWAVVEKDSLNETDGKIIMSGSRIIPMDAAMMSDFDKGNAQSQTAERTRLRSIRKLNERHKIRRQRLNRVLSILKYLPEHYANNIDRYGNIDENKEPKIAWKINSNGRKEFLFMDSFEEMVAEIHQKHPDAKTIPYDWTLYYLRSKALHKPISKFELAWVLHSFLQKRGYYQLRGEEEDSTAKKEEYASLKVISVEDSGDRKGNNTWWNVNLENGLTYKVCLQDRPPLEGKTRDFIITTKLDKEGKPALDKDGKPRYSIRAPKDDDWGLMKIRTESQIAKAGMTVGQYIYNTILNTLDKKIRGQIVRTIERKYYREELLRILECQIMFHLELQDKELYTECIEALYPSNDSYRASIATRNFKYLIADDVIFYQRPLKSKKSEISDCPYETRTFVDKSTGEIKKTSLKCISRQNPLFQEFRLWQFISNLRIYKRYDAEDGRIVINKDITKDLLPDANVVASLYEWLSTKAGVSQEQLLKYLKLSSADYRWNYVEEKKYPAGETRAMLMSGFKKAGIDTNLLTEEIEMALWHILYSVNDRQELIKALSSFAVQHQWPAEVFSNVFCKTKPFEDYGAYSEKAIKKLLPLMRVGKYWTADDIDPATRHRIQLLITGEDDSELNLRTRDKLEDLKSIDDFQGLPVWMACYVVYGRHSESGNILKWSNPHDIDIFLNNFKQHSLHNPIVEQVVLETMRVVRDVWAKFGNLDEIHLELGRNLNQTAEQRKRDTERNLGNERANLRAKILLTEFLNPEMNVENVRPYSPSQQELLRIFEEGIIDDSTGNMPDDIQEIIKKLDSSDIKRRPTESEILRYRNWLEQGYRSPYTNEIIPLSKLFTPAYQIEHIIPQSLYFNNSYNNKVICETEVNQLKSNQLGMEFVKNHGGEIVECAFGRKVRILTPEEYTAFVEQHYKHNIHKKNNLLSTELPSEFSSRQLNDSRYISKLMIGLLSNIVREDADGQLEEEAISKNLIVCTGKVTERLKQDWGLKDVWNEIIRPRFERLNHMEQSERFGHWENKQGKNVFQITIPLELSSSVDRKRIDHRHHAMDAITIACATRNMVNYLSNQASGKARYDLQHVLCVKQKMDAQGNYKWLIRKPWQTFTEDAKAAIKEIVVSFKQNLRVINKTSNHYEAIGSDGKKILRRQTKGDSWAIRKSMHKDTVFGNVNLRSVKQVTLKQALQQVDRICSKELKKYILSLQKLHFSDKGIEAQLKEKGRQLFPNIDLKKIDIYYFSNDSENTRMVATRKPLDASFNQKAIEAITDSGIRKILLNHLEQYNGDSEAAFSPMGIEQMNEHITSLNNGIPHKPIYKVRKSEIQGSKFPVGTKGCRSKKFFEADKGTNLFFAIYVDSEGKRSFDSIPLNIVIERQKQGLPSCPEKDSNGNTLLFCISPGDTVYVPTPDEMETGNIDLNYIDKGRLYKMVSCTGKESHFLPLSSATTIKDKYEYSSLNKLGRALSGEMIKDICIPIKCNRLGELLP

SEQ ID NO: 1752 - protein, 979 aa, unidentified
  REGION 1..979: note = Description of Unknown: uncultivated organism with predicted taxonomy: Bacteroidales
  REGION 1..979: note = MG22-98 effector
MTRKILGLDLGPNSIGWAVIARETSSDEENSGRIIDAGSRIIPMIDDSKFEKGETISATKDRRQKRSMRRMLERKKQRRQRLLRALNVMGFLPEHFAAYIDKHGNMRHDCDTPLMAWEQNADGHRQFIFTDAFEEMVADFRQHAICSCADGKLIPYDWTPYYLRKKALTTAISREELAFVLTQFNKKRGYHQLRGDELDEAEQKSKNQEIRTLTVKEIIDYKKISQKHKYTFLLSNGMAFERESTSKLDDWVGKERDFIITTEYDEEGNIKKNRFGEDKISIRAPEETDWTLRKKKAENDISDKKEVGEYIYDELLRTPDMKIIGGKVMTIDRKFYRRELRKILATQEPYHPELKDESVKRKVAKALYPNNTDHRRAIMRKSLSDIIVDDIIFYQRSLKSKKSTIADCPYEKRYYKDSEGMLKKTGVKCISKSHPLFQEFRTWQFINDLCITRQGEPVDFSNEEAADLFDYLHCKEKTNETDILKNFLKLNKQEQELHKWNYGKDAEKPCCPTHCQFVERFKKIGLEPSILTAETEQVLWEIAYSVKDVAEYNKAIEKFADRIGADREEFTKAFRNLPDYKSEYGSYSHKAICKLLPLMRRGSAWQWEAIDKDTREKIGHIINGEHDERLTEDTRQNFSKKTKEDDFQGLQPWEACQLVYGGQTDDEEIQKWDSPEDVDKYIASFRQHSMRNPVVEQVVLETLRTARDIMRRYGKVDEIHLEMARSMKQTSQQRKADNERMQSNYKRNQEVRDKIAEELQQNATNGERPKIGAKKIASYKIWEDQKGRSPYTGKAISDAALLNADGRYDIDHVIPQSRYYDDSLNNKVICEKEVNLKKGNMLGLEFIQKHGGETIQLSSGGEVTILREEEDKKLVNETFKGRKQKIMLMTETPNDFTNRQKTDTQYIASTMMRLLSNIVREQDPDGSLEREVRSKNPIVCTGGITDKLKKDWGVNDAWNRIILPRFKRMDELTMAERTG

SEQ ID NO: 1753 - protein, 1537 aa, unidentified
  REGION 1..1537: note = Description of Unknown: uncultivated organism with predicted taxonomy: Flavobacteriales
  REGION 1..1537: note = MG22-99 effector
MAKYILGLDLGPNSIGWAVVEGVEQEEHVGLVPQRIVMSGSRIIPIDKTTLSNFETGNTVSQTADRTQKRGMRRNLERKKLRRQRLFRVLKTMGMLPRHFAEHVDGLGNLDEDGRRLSMAWAPQEGERPLFLFQDAFAEMVGEFAARQPQLMLGGKLVPKDWTLYYLRKKGLTDRLEKEELAWVLASFLQKRGYRYMRGQDADNTKENEKKELRTLEIVDLISDGDGSKKGKGVDLVLEDELRFTVKNANEADFKRGQTLDFIVTTTYDERGKVKMDANNKPMRKLSMPKEGDWELLKTRTEQRIRVQEGSTVGSYIYESILENPDVKIIGERVHVVGREFYEEETKRILEAQTQFHPELSDPEMRDKVAHALYPNNEAHRNAILNRSLADIIVADVVFYQRPLRSKKSSISDCPFEKRNYVGSDGEERKVGVKCISKSHPLFQEFRTWQFVGNVKLVSKDDSGDDKNLSLLGRKKCFNGGTCEEGAELFEWLHNRKSVKQGDFLKGFVGLTKGEIDRYYRWNYEADKEIPCCETRAEFLGYFKKAGLPADALTEEAERRLWEVAYSVSDREEFRKALRSYARWIGADEERFVEACGKMKPFPSDYGSYSEKAIKKLLPLMRTGKYWSFDAIAPETQSKIRHLITGEEDERLTDEVREHFKYRVDEANYQGLQLWEACELVYGSSFSKDDIAHWKSPDDLDRWLEGFRQHSLRNPIVEQVVLEAVRTVRDIWRKIGHIDEIHLEMARDMRKTAQERKRDSERNSQNFKARQRIKMLLDEFEKMRIDDVHPYSPMHQEKLRIVEDGVFDRVSAKGDEKSKEMLKDMRAFQTNVEKNNVTPGDISRYMLYLEQNYRSPYTNETISMKRLFSSDYEIEHVIPRSRFFDDSMSNKVICEAKVNKEKGNMTGMEFIMKRGGEKIELGEGREVTIVNEKDYRQYVDEVYKNNSRKRKNLLSEDIPGGFSNSQMNNTRYISRLVMTILSNIVRDDREDGKSDEGIRANRLITCQGGVTDKLKKDWHVNDVWNRIILPRYERMQNEVMKGVTFVTNNSRGHEIPTMPDKLKTEEYNPKRIDHRHHAMDAIVIACATRSIVNFLNNESARDEASEGSEKAKARQTYAELRSLLCVKDADNDEKVIRKPWENFEVDVLKALEDIVVSTKHKQRVLTRTSNHYEKFVDGKKQKVSQKGKSYAVRLSLHKDTVWGQVNLRRQEGVSLLTALKDPQRVVDKALRKKIVELQAQGKKPKDIKKYFAENADVWPETQGKVAVWHFTDDEPTKTYATRFISSLTELFDKISTREKAEEKIQSITDTGIQKILLAHLAECNYDVAEAFSPIGIERMNANIVALNGGKQHKPIKKVRRTESGSKFAVGASSGSRHKFVENAKGGNLFFAVYLAVSEDKNGNEVRKRQYETLPLRTVLDRLKQGLSPVPEVDEGGNRLLFSLCPYDLVYVPKEGENVGELTAERLDKERIYMFVSSSDSDAMFRPHRVAAPIVEKKEFTLHNKMSKAVTGEMIKEVCIPLEVDRLGDITKKRIGDD

SEQ ID NO: 1754 - protein, 1489 aa, unidentified
  REGION 1..1489: note = Description of Unknown: uncultivated organism with predicted taxonomy: Bacteroidales
  REGION 1..1489: note = MG22-100 effector
LGPNSIGWAVVQTELDDEKKDTLYSSGKILMSGSRIIPMSADIMNNFQKGVSVSQTAERTRYRLVRRQYERFHLRRERLNRVLMTMGYLPEHYAEQLDRYGKLPKGKEPKLAWRMAKDGKPEFIFREAFLEMVDEMRAVHPDLQQIPYDWTIYYLRKKALSRALRPEELAWVLHSFNQKRGFFAVRGQVDTDAEAPDKLQEYHKARLASVVDTGEKNRGNAVYRLCFDDGVEFEVALRRMTLQVGDDVEYIKTTKLDDDGMPKQTKQGKPDISYKIPGANDAWTLNKLRAEYTIDQSQSTVGEYIYKALLTNPQQKIRGELVRTIDRHFYRDELRRILQAQKPHHPLLQDQEMLDECLQMLYPHNESHSNSMRGRDLCALLTDDIIMYQRPLKSKKSLIAGCKYETHRYVDKDGKMKTEGVKCASKSHPLFQEFRLWQFIENLRIIQRKDTSNGRVRYDVDVTEQFIHDYEGRAALFEWLQTRSKIKQDALLKHFGMKEEGFRWNYVEDREYPAGETRAEMLKRLKKAGVDADFLTAERELALWEILYSVNGQEELGKALRTFARKHQLDEEKFAQNFCTIKPYPSDYCAFSVKALKRLLPLMRCGKYWTAEQIDASTAQRIQKLIDGEYDEQITEQVRNATATLRSVGDYQGLSTWLASYVVYGRHSEASDTKKWETPEDMEADIKAFRQHSLRNPIVEQVCLETLRTVHDIWKEVGHIDEIHVEMGREMRATAKEREERSARQLRNEQTNLRIKALLQEFMNPALEIEDVRPYSPSQQELLHIYEETVLEQEAGNIDDDIREIIRKFTQTEASKRPTEGEVRRYKLWLEQRYRSPYTGKNIPLGKLFTPAYQIEHVIPQSVYYDNSYNNKVICEAEVNLLKGNMLGMAFIKEHAGEIVPLSLGGEVEILKPDTYREFVEEHYKGRKRQIMLSEEIPTEFTSRQMNDTRYIARFIMGELSKLVRQQNADGTYEEEATSKNVIVLNGAITDKLKKDWGLVDVWNGIIAERFKRLNQMEGGTRFGHEENKDGKRYFQIEMPLELQRGFNRKRIDHRHHAMDAIVIACATRAVVNYLNNDHAHDGAGREDVKRAVSRKRDQTWLINKPWPTFTEEAKEELKQMVVSFKQNLRVINKTSNHYEKYNTATGKKEKFRQHHGDNWAIRKALHKESVFAQVNLRSIQTVNFKTAYEQVLRIVDKRLKRAIRDAKNRYAMRCTDKQILKYLQGMPEWKDYDFKRIAIYAFSNDQEKTQMCAIRKRLDDSFDKKKIASVTDTGIQQILLHHLEENGNNPKEAFSPEGIERMNANIAALNNGKAHQPIYVVRISEPMGQKFAVGHIGNRSKKFVEAAKGTNLFFAIYDLGGDRRGYTSLPFREVVERQKLGYPTAPETDEEGHRLLFVLRPGDLVYVPTEEQLQSRIDARAIDKSRIYKMVSCTGNECHFIPANTASFIRDKYEYGSLNKLARAITGEMIKEICIPLEIDRLGRYRIK

SEQ ID NO: 1755 - protein, 1215 aa, unidentified
  REGION 1..1215: note = Description of Unknown: uncultivated organism with predicted taxonomy: Bacteroidales
  REGION 1..1215: note = MG22-101 effector
RIPNADDAWTLNKLRAEFTIDQSHSTVGQYIFNAILRNPQQKIRGELVRTVDRRFYRDELRRILEVQIPLHPALQDREKLEECLLALYPNNEAHRRSMQGRDFKALLMDDIILYQRPLKSKKSLIGECKYETHTYINKEGKRETIGLKCASRSNPLFQEYRLWQFLENLRILKRKTLDGNHYRTDVDVTTLFLRTDESYTSLFDYLRSRAEIDQKTLLKFFKLKEEDYRWNYVEERKYPTSETRAEMLKRLKKAGVPTEFLTHELEMALWEILYSVSGQSELEKALRKFAEKNNLDQETFYQCFRTIKPYSADYCAFSTKALRRLLPLMRRGHYWNYNAIDPLTQQRIARLINGEEDTTISNRVREKAETLRTETDYQGLPTWLASYVVYGRHSEASEIKKWASPEEMDRDIRCFRQHSLRNPIVEQVCLEALRTVRDIWKEIGSINEIHVELGREMRATAKERESRHNRQLENEQTNLRIKALLQEFMNPEFGIEDVRPYSPNQQELLRIYEDTVLSQEAGRVDEPIREIIRKFSQTDAAKRPTTAEVLRYKLWLEQKYRSPYTGEPISLSKIFTSAYQIEHVIPQSVYYDNSYSNKVICEAEVNLLKGNMLGMPFIMQHAGEKVQCSVGNIVTISTPEAYRAFVEEHYKGKKQKILLSEEIPTNFTARQMNDTRYISRFIIGELSKLVREHNPDGTLEQEAVSKNILILNGAVTDKLKKDWGLVDVWNGIIAPRFRRLNAMEGSQRFGHEAMKDGKRYFQIEMPLELQRGFQRKRIDHRHHAMDAIAIACATRNVVNYLNNDHSHEGAGREDIKRAVSSKRSGQWLVNKPWSTFTQEARKQLQQIVVSFKQNLRVINKTSNRYVRYNPQTRKKETIVQQKGDNWAIRKPLHKESVFGRVNLRTQKAVNFKTAYANIERIVDKRFKHAVLAAIKRYGGKCTDKQVLKYMQGMPEWKDFDFKKVQIYVFSNDDVKTQTSAIRKRLDDSFDKKKILTITDTGIQRILLRHLEQNGNNPKEAFSPEGIVRLNESMLELNGGKPHLPIFAVRISEPLGNKFSVGMRGNRSKKFVEAAKGTNLFFAIYQQEDGRRLYRSVPLNEVIERQKQGLSSAPEHDENGNALLFVLSPGDLVYLPTKEERNSRIDVQAIDKTRIYKMVSCSGNQCQFIPINVASAIVDKYEFSSANKMERAITGEMIKELCLPIEVDRLGRYRLK

SEQ ID NO: 1756 - protein, 1377 aa, unidentified
  REGION 1..1377: note = Description of Unknown: uncultivated organism with predicted taxonomy: Clostridia
  REGION 1..1377: note = MG23-1 effector
MGKKMYVGLDMGTSSVGLAVTDENYKLYRVKGKDYWCSRTFDEADTAVERRTNRISRRRRQREVARLGILRELFADEIAKVDPGFYARLDESKYHLEDRDNKQPYAIFADKGYTDKEYYARYPTIFHLRSELIDSDKPHDVRLVYLALANMFKHRGHFLNDSLSSDKPLADTTEAYSNFYYTASELSISFPAEAQPDSIDAASLEALLGDKGVSRTDKAKNICQYLAIDKKTSKPLYTLINLICGLNIKLIDIYGAELIDEENKKLSIGFRDSSYEQQDADGRKLLGENYAIIDAAKELHDIGLLSSIMKGYKYLSQARVALYEEHAADLKKLKSVLKRYDKDSYRKVFRSMDEGSYSAYIGSVNSGTKIRRGVKDGSADTFCKSMKKVLEKLPKDDMDVQYLLAKATDSSLLPKQLTFENGVIPNQLHAAEMKAILRQAEKYLPFLLEKDEYDLTVSQRIIQLFTFRIPYYVGPIGKNHAGEKGYNIWATRRAGEEDGRVYPWNFEQKIDTKAAAEKFIERMVRHCTYINGERTLPKCSLLYEKYMVLNELNNLRINGEKPAVSVKQDIYTKLFCRGKRVTMKMLKDYLYNSSLIPSKEDVVISGIDNGFNTSLTSVGKFRGILGDAVFADSNQKMIEDIIFWGTVYGNDKKFLKERIEEVYGDRLNHDEIKRILGFNFNDWGNLSREFLELEGECECGRCSIIQAQWNTNHNLMELLSDQFTFKNELEKKTGSAEKALADWSIDDLEGKYLSAPVKRMIWQTIKMLREVCEVTGRTPDKVFVEMAREDGEKGARTVSRKKKLLDLYDAIKHEERELAKVFSDEIDSKTEADFRSKKLYLYYLQQGRCMYSGDIIHLSDLMNDNLYDIDHIYPRHFIKDDSLENNLVLVKKQINNRKQDTFPIERSIQEDMRPFWKSLADSGFISAEKYKRLTRRDAFTDEEKAAFISRQLVETRQGTKAIADILKQALPDTEIVYVKAGLVSDFRQKFELYKVRALNDTHHAKDAYLNIVVGNTYSTKFTNNPLNFIKAGAKRPQDNQFKYNMDKIFDYNVISRGERAWIAGSDGSICTVKKFMSRNTVLITRKAKEVHGALSNKATIWGKNVAKPGAYLPVKSTDLKAQDVTKYGGITSIANSGYTLAEYKVNGKTTRSLEALPVYLGRAEQLTEKTVVDYLSSSLQESSKKKIEDIQVRKLFIPQGSKVKIDGFCYYLGGKTGDSIYLNNAVPLYLSSTSEEYLRKLLKAVENNNYNERDKNGQIILTAPKNVQLLSSIFDKLRSKPFSNNKWNIYFSIVNGKETKVEQLFSKLSIDKQAEVISQIVIWINSSRQNVNLSLIGGSAHSGTQALSKTVSRLNECMLISQSITGIYEHSVDLLTI

SEQ ID NO: 1757 - protein, 1375 aa, unidentified
  REGION 1..1375: note = Description of Unknown: uncultivated organism with predicted taxonomy: Firmicutes
  REGION 1..1375: note = MG23-3 effector
MSEKIPYYIGLDMGTNSVGWAVTDENYKILRGKGKDMWGVRLFDEAQTAAERRTNRVSRRRRQREVARIGLVKEYFADALNAVDPGFMVRLEESKYWLEDRSEENQQKFALFNDKDFTDKEYYTVYPTIFHLRKELIESTEQHDVRLVYLAILNLFKRRGHFLNKSLESDGETMSMAEAYAALVDEAAALEITLPMPIDAKKLEEVLSQKGVSRKFVEQDTNEFFGFSKKASEARELVKLMCGLTGKMRNIYGEELIDDDNKKLALSFRSNDYEEKMNEVAELVGDENMRLLEAVKEVHDIALLANILSGEQYLSVARVKQYNKHKEDLQQLKRVLRTYDKAAYKKMFRVMGKDNYSAYVGSVNYKEHKERRNAGAGKDGESFRKAVEKVIDALPEEAQLDQDVIEIREKIKNEAFLPKQLTSANGIIPNQVHLRELKRILENASGYLPFLNEIDESGLTVKERIAQLYEFQIPYYVGPLSKQNSKNAWANRRPGEEKGRILPWNFEQKIDVNQAAEDFIKRMVRHCSYLDAEFTLPKQSLMYEKYMVLNELNNLRINGEKPTVLQKQQIYNELFGKGKRITQKALINYLKDEGIVEKDSEPIISGIDGDFKASLSTFGKLRTVLKEEARKDSSQEMMDQIVFWATVYGDDKRFIRARIEEHYSEILDDHAIKQLLGMKFNGWGNLSKAFLEMEGASKEDGVYRSVIQALWETNDNLMELLGQRYTYKEELEKRVQTKEKPLAEWTIDDLDGMYLSPSVKRMVWQTLKIIREITEVRGSAPSKIFVEMARDDAQTKAKNKGKRTKSRKDFLLECYKDDKAWKDELTSVDDGELRAKKLYLYYLQMGRCMYSGEAIDLASLMSGNTMYDIDHIHPRHFVKDDSLENNLVLVKKDKNAHKSDNYPLESEIRNKQFGFWKSLLDKGLITKTKFTRLIRSEDFSPEELAGFINRQLVETRQGTKAITKILQQAFPDDDMEVVFTKAGVAAKLRHDFDLVKVRCVNDTHHAHDAYLNIVAGNVYNAKFTSNPLRFIKNEVKKGNASYHMDKIFFRDVKRGNKLVWQAPNNEEKTPGTIAIVREQLARRTVLQTRRSYMAHGILSDATIYSKDTAKTESYRPVKSSDERLSDVKKYGGMTSIKNTAYALVEYTVKGKTIRSLEGVPIYLGNCSKDDKKLLQYLQEILQRENKNKQVENVSVRMYPIRQRSYLKVDGYYYYLGGATGSSVYLLDAMSVYLSKEDMGYVKKVEKAVAQQRYDECTKEGEFVLTREKNMDLYNKLVDKFSHGVFIKRKASILKTLEEGIDVFSELNIEKQCGIIMQIFAWITTSQQNVNLTDIGGVAHAGTLLISKKLSTSREALLIEQSLTGLWSKTTDLLTV

SEQ ID NO: 1758 - protein, 1371 aa, unidentified
  REGION 1..1371: note = Description of Unknown: uncultivated organism with predicted taxonomy: Clostridiales
  REGION 1..1371: note = MG23-4 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYLELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAIIQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYWVKGKSVLSLEAIPGYLGNAEHISDETLLRYLQDSLEKENPGKVISDLQIKYRCIRYKSLLKIDGFYYYIVGKTGKRIYLESAVPLILNNEDAIYLKKIEKAVSGQYFEEKREGQLIITEERNQKLYDILLEKLTDGIYRNKKASLQTILQEGREKFIRLSIPNQCQILMNLVEWFQLSCVTADMKEIGGSANSGKCLMGKKISDCSEMILITQSATGLQERRIDLLKL

SEQ ID NO: 1759 - protein, 1385 aa, unidentified
  REGION 1..1385: note = Description of Unknown: uncultivated organism with predicted taxonomy: Firmicutes
  REGION 1..1385: note = MG23-5 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLAVSKKDKAATELISMMCGLMGTLQKIYGSDLIDDEHKGMKISFRAMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILENASGYLPFLNEKDDSGLTVKERILELYSFQIPYYVGPLGQQHEGEKGYNVWAKRRPGEAKGRILPWNFEQKIDVNQAAEDFIKRMVRHCTYLKGENTLPKQSLLYEKFMVLNELNNLRIRGEKPSVEVKQEIYETLFMTGKRVTRKQLLKYLVANGLLNEDDGDMVSGIDQDFKASLSSLNKFKGVLGDAAVYDSNRAMIEQIIFWATIYGDDKHFLKNRIKEHYGDSLDNQQIKRICGMKFNGWGNLSKTFLELQGASKEDGVYRSIIQSLWETNDNLMQLLSERYTYSEELEKMIGDAEKPLSEWKIEDLDDMYLSPSVKRMVWQTLKILNEIVEVRGYAPDKIFVEMARDSAQTRARNKGKRTQSRKEFLLNVYKEDKEWRKEIQSCEEIKFRKKKIYLYYLQHGKSLYSGKTIDFDTLLSDNDAYDIDHIYPRHFVKDDSLENNLVLCLKSENAKKGDQYPLRKTFDSAVLSSQEGVWKSLLKQKVITKEKYDRLVRTADFTIDELAGFINRQLVETRQGTKAITQILKRVFKNEAVEIIFTKAELISDFRRIFDLPKVRCVNSTHHAHDAYLNIVVGNVYNAKFTKHPRHFIEECQRKGSYDYNMYRMFDYDVKCGSKIVWCGSKITTCGKGTISTVKKQLQKRSVLLTKKSFMKHGKLFAANNTGKESIKSDAYYSDKTTDIRLLDVQKYGGKSDISNTAFALVEFYSKGKPVRILERIPLYLNITNNNDENLNNYISKKIKKDLKNVEISEMSIRMYPIRQYVKLKINGYFYYLSGSDDDTRVSLRDAVTFYLSDEEMAYVKYIEKAVETQNFYRQKNKKAVLSEAGNIKLYEVLIEKLQQGIFLKKKISIVPVLLEGKEKFKALPLEKQCYIIMQIFAWITSNQQGVNLKDIGGASNAGKLKMSKNISDLSEAILIEQSATGLYERRIDLLTV

SEQ ID NO: 1760 - protein, 1382 aa, unidentified
  REGION 1..1382: note = Description of Unknown: uncultivated organism with predicted taxonomy: Clostridiales
  REGION 1..1382: note = MG23-6 effector
MDKVKQAPYYIGLDMGTSSVGWAVTDEDYKILRGKGKDMWGVRLFDEAKTAAERRTFRVARRRRQREVARIGLLREYFADAIHEVDPGFFHRLEESKYYLEDRDDDNQQKFALFNDKNFTDKEYYAQYPTIFHLRKELIESSDPHDVRFVFLAILNLFKRRGHFLNKGLSADGGESSMAEAYETLVEEARNQEIILPEALDTQALEACLGEKGLSRSTIKENVMELLVVSKKDKAATELISMMCGLKGTLQKIYGSDLIDDEHKGMKISFRDMNYEEEAAEIVALIGEDNFALLEAVKEVHDIGLLAHILEGEQYLSMARVKQYDAHHEDLLQLKRVLKKYDKDEYDKMFRMMGQDNYSAYVGSVNYNENKVRRNGGKGKDVEAFYKNVKKVMDKLPEIAQNDPDVKDIRTKIEGEAFLQKQLTASNGIIPNQVHTRELKAILEKASGYLPFLNEKDDSGLTVKERILELYSFQIPYYVGPLGQQHAGEKGYNVWAKRRPGEAKGRILPWNFEQKIDVNQAAEDFIKRMVRHCTYLKGENTLPKQSLLYEKFMVLNELNNLRIRGEKPSVEVKQDIYETLFMTGKRVTRKQLLKYLAANGLLNEDDGDMVSGIDQDFKASLSSLNKFKGVLGDAAVYDSNRAMIEQIIFWATIYGDDKHFLKNRIKEHYGDSLDDQQIKRICGMKFNGWGNLSKTFLELQGASKEDGVYRSIIQSLWETNDNLMQLMSERYTYTEKLEKMVGDAEKPLSEWKIEDLDDLYLSPSVKRMVWQTLKILNEIVEVRGYAPDKIFVEMARDSAQTRARNKGKRTQSRKDFLINAYKEDKEWRKEIESRDEAEFRIKKLYLYYVQMGRCMYSGEAIDLHALMAGNEQYDIDHIYPRHFVKDDSLENNLVLVKKTINAHKSDTFPLEAELRKKQYAFWRSLLDRGLITQNKFNRLTRATGFSNEELAGFINRQLVETRQGTKAITQILKEAFKNDDTRIVFTKAEVTADFRHKYDLPKARSVNNLHHAHDAYLNIVAGNVYDAKFTSHPINFIKECRNKGVFNYNMAKVFDYNVKRGNRYVWIAQNDGMDMPLTIERVKNQLARNTILMTRRSYMAHGGISNKATIYGKDTAKPGSYLPVKSSDSRLSDVTKYGGITSVLNTAYALVEYKVKGKMVRSLESVPLYVDATGKDDEKLLNYLRESLQFENKKNLVENVSVRLYPVRQRSLLKLDGYYYHLGGGAGSMFYLIDAVPMYLPQKVVMYIKKIEKAMETQRYDEINSKNEVIITKENNAETYDLLLHKLTKGIYSHRKASIINILVNGEEKFDSLNLEAQCSVILKIFAWINSSQQTVDLKDIGGSANSGFLKTSRKLSNSTEAILIEQSATGLYERRIDLLTV

SEQ ID NO: 1761 - protein, 1371 aa, unidentified; identical to SEQ ID NO: 1758
  REGION 1..1371: note = Description of Unknown: uncultivated organism with predicted taxonomy: Clostridiales
  REGION 1..1371: note = MG23-7 effector

SEQ ID NO: 1762 - protein, 1371 aa, unidentified
  REGION 1..1371: note = Description of Unknown: uncultivated organism with predicted taxonomy: Clostridiales
  REGION 1..1371: note = MG23-8 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNQEGYDKMFRVMEPGNYSAYIGSVNSKESGKVRRNEGKGRSREDLYKTIRKLLGQCPQDDQDVALILSKIESETFLPKQLTADNGVIPNQVYVKEMRKILKNAATYLPFLKEKDESQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMPREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKQIYLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERRIDLLKL

SEQ ID NO: 1763 - protein, 1371 aa, unidentified
  REGION 1..1371: note = Description of Unknown: uncultivated organism with predicted taxonomy: Clostridiales
  REGION 1..1371: note = MG23-9 effector
MEERKMYWGLDLGTNSVGWAVTDQNYQLMRAKGKDLWGARLFDRADTSAERRGYRVSRRRRQREVARCGVLKEYFYEEISKMDAGFFVRLEESKFWKEDRSEGNQQKYALFADANFTDKDYFEKYPTIFHLRKELLETSEAHDVRLVYLALLNMFKHRGHFLNTALSAEETETDMNAAYQELVDTAGYFDIAFDPQLDAREIENILGEKGISRSRILEKLSTYMGISKSDKAAYELLKLVCGNAGKLVNIYGSEILGEENKTLSISFRDSNYEEKETQVKELVGDDYFELLLAAKAVHDIGLLANILKGHAYLTYARVESYEEHKKDLQLLKCVLKKYNPEGYDKMFRVMEPGNYSAYIGSVNSKESGKVRRNEGKGRSREDLYKTIRKLLGQCPQDDQDVALILSKIESETFLPKQLTADNGVIPNQVYAKEMRKILKNAATYLPFLKEKDEFQLTVAERIIQLFSFRIPYYIGPLGQEHLDEKGYNEWARRIAPGKVYPWNLEEKFDTKEAAEKFIERMVRHCSYLTQEKTLPKNSLLYEKFMVLNELNNLKIHGEKITVEQKQDLYNSLFIKGKRVSIAQIVRHCQLSGWVEKDDTDFLSGIDLTGFKASLSSVGKFRGVFGEGFFNDKQTAMAEQIIFWATVYGNDKSYLRERIEEEYSELLDEKQIKRILGFKFEGWGNLSREFLYLRGTSRQDSERSVIMALWETNDNLMELLSERYTYKEALQEQIKEKEKTLEEWTIEDLGGMYLSAPVKRMLWQTMKILLELKQTLGQTPDRVYVEMSREDGEKGERKDSRKKKLLDLYSALKGEEKAWRKEIEDRPEADFRIKKLYLYYRQMGKCMYTGETIELADLFNDNLYDIDHIYPRHFVKDDSIENNLILVKKQKNARKGDSYPIEREIQRARYQLWKMLADKNFISREKHQRLIRTTPFSEEEKAGFISRQLVETRQGTKAITQILRQIFPDTMVVFSKAGEVSAFRHKFNLEKVRCLNDFHHAQDAYLNIVVGNAYYVKFTANPINFIREAEKNPQKDLYKYHMDKFFEYTVQRGDETAWIGTKDEKNSTIHIVKKVMARNTPLITKRCYTVHGGITRKDTIYNKETAKGQGYIAVKGSDPRLCDVTKYGGRTSINNMFYTLASYRVKGKSVLSLEAIPGYLGNAENISDETLLRYLQDSLEKENPGKVISDLQIKYRCIRYKSLLKIDGFYYYIVGKTGKRICLESAVPLILNNEDAIYLKKIEKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERCIDLLKL

SEQ ID NO: 1764 - protein, 1389 aa, unidentified
  REGION 1..1389: note = Description of Unknown: uncultivated organism with predicted taxonomy: Clostridiales
  REGION 1..1389: note = MG23-10 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRVVKQKYALFADKGYTDKEYYKEYPTIFHLRNELLHPQKNSYDVRLVYLAIANMFKHRGNFLNETLDIDKITANAVDVYSQLVEELDLYCIQMPVSIDIGKLMNIIGENGISRSKRLENASKYLGITKKDKQSYEILKLICGLKGILYNIYGENVIDEENKKFSLSFTGSIYEDSEAQAKDILGDEYFELIEIIKELHDICVLSGIIKGHKFLSEARVELYEEHKKDLDMLQQVLKKYDKNAYDEMFRVMKEGNYSAYVGSVNARGKNKKIRRNVGEGKKGKNGRSQETFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1765 - protein, 1368 aa, unidentified
  REGION 1..1368: note = Description of Unknown: uncultivated organism with predicted taxonomy: Butyrivibrio sp. CAG:318
  REGION 1..1368: note = MG23-11 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1766 - protein, 1109 aa, unidentified
  REGION 1..1109: note = Description of Unknown: uncultivated organism with predicted taxonomy: Butyrivibrio sp. CAG:318
  REGION 1..1109: note = MG23-12 effector
LCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1767 - protein, 1389 aa, unidentified
  REGION 1..1389: note = Description of Unknown: uncultivated organism with predicted taxonomy: Clostridium sp. AF36-4
  REGION 1..1389: note = MG23-13 effector
MEINLENNAEEIIMGKKMYIGIDMGTSSVGMAVTDENYNLYRVKGKDFWTSRLFKEANTAVERRTNRVSRRRRQRETARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKMLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1768 - protein, 1368 aa, unidentified
  REGION 1..1368: note = Description of Unknown: uncultivated organism with predicted taxonomy: Butyrivibrio sp. CAG:318
  REGION 1..1368: note = MG23-14 effector
MDKKMYVGIDMGTNSVGMAVTDEEYNLYRVKGKDLWCSRLFTEADTAAERRTNRISRRRRQREVARMGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADETYQQLIEMAMMYSIEFPKNINVEKFIDIIGENGVSRSKHLENVCEYLGITKKDKPAYEILNLVCGLRGVLINIYGNEVIDEENKKFSICFRDSNYEEKEGEALELLGDEYFELLETIKEIHDIGMLAGIIKGHKYISEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHASELKAILTNAEKYLPFLLGKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLKIDGKKPSVQVKQGIYEELFKTGKRVTLKQLKKYLYNNSIIASEENVVIEGIDGGFNSSLTSVGKFRGVLGDELFTDANQAMAEEIIFWGTVYGNDKKFLKDEIESKYGTVLSKDQIKRILGFKFNGWGNLSKTCLELQGSCECGDCSLIQALWETNHNLMELLSEQYGFKKELDALACNVEKPLTEWTIDDLDNKYLSAPVKRMVWQTIKMLREVCELTNKEPDRVFVEMPREHGKENDRKTSRKKKILDLYSALKREKKEWAELKIREIEGRTEADFRIKKLYLYYLQQGRCMYSGEKIELNDLFNNNLYDIDHIYPRHFIKDDSLENNLVLVKKEINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLIEYKVKGKKVRSLEALPVYLGRSNTLTDEDIMQYISNVLQKEYAGKEISDLSVRVPFVPQKSKVRVDGFEYYLGGKTGNYICLNNAMPLYLSGNDEEYLRKIMKAIEIDNYEEIDKDSNAIITEEKNAALFNTLSVKLNSEPYINNQWNIYKILEGKEEIFKDLDIQKQCYVIVKIIDWIKSKTQGVDLTDIQGKNQSGTMKVNKRISECKECILIHQSVTGMYERRIDLLSI

SEQ ID NO: 1769 - protein, 1366 aa, unidentified
  REGION 1..1366: note = Description of Unknown: uncultivated organism with predicted taxonomy: Butyrivibrio sp. CAG:318
  REGION 1..1366: note = MG23-15 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKIPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSLLYEKFMVLNELNNLKIAGKKPSVQVKQDIYEKLFKPGKKVTLKQLQEYLCNNSIIASKEDIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1770 - protein, 1389 aa, unidentified; identical to SEQ ID NO: 1767
  REGION 1..1389: note = Description of Unknown: uncultivated organism with predicted taxonomy: Clostridium sp. AF36-4
  REGION 1..1389: note = MG23-16 effector

SEQ ID NO: 1771 - protein, 1366 aa, unidentified
  REGION 1..1366: note = Description of Unknown: uncultivated organism with predicted taxonomy: Butyrivibrio sp. CAG:318
  REGION 1..1366: note = MG23-17 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1772 - protein, 1389 aa, unidentified
  REGION 1..1389: note = Description of Unknown: uncultivated organism with predicted taxonomy: Clostridiales
  REGION 1..1389: note = MG23-18 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1773 - protein, 1368 aa, unidentified; identical to SEQ ID NO: 1768
  REGION 1..1368: note = Description of Unknown: uncultivated organism with predicted taxonomy: Butyrivibrio sp. CAG:318
  REGION 1..1368: note = MG23-19 effector

SEQ ID NO: 1774 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-20 effector

SEQ ID NO: 1775 - protein, 993 aa, unidentified
  REGION 1..993: note = Description of Unknown: uncultivated organism with predicted taxonomy: Butyrivibrio sp. CAG:318
  REGION 1..993: note = MG23-21 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMRAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESDIRKNMNEFWKSLREKNFISKEKYSRLIRTEEFTDEEKAAFISRQLVETRQGTKAITQVLKQAFPNTQIVFVKAGIVSDFRKKFDINKVRALND

SEQ ID NO: 1776 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-22 effector

SEQ ID NO: 1777 - protein, 1366 aa, unidentified
  REGION 1..1366: note = Description of Unknown: uncultivated organism with predicted taxonomy: Butyrivibrio sp. CAG:318
  REGION 1..1366: note = MG23-23 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1778 - protein, 1383 aa, unidentified
  REGION 1..1383: note = Description of Unknown: uncultivated organism with predicted taxonomy: Clostridiales
  REGION 1..1383: note = MG23-24 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNACGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1779 - protein, 1368 aa, unidentified
  REGION 1..1368: note = Description of Unknown: uncultivated organism with predicted taxonomy: Butyrivibrio sp. CAG:318
  REGION 1..1368: note = MG23-25 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKESYDVRLVYLAIANMFKHRGNFLNESLDADKITSSADEAYRSLVETAMMYSIEVPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFQEDDEEIKTILSEIDSETFMPKQLTASNGVIPNQLHVSELKAILTNAEEYLPFLLGKDESGLTVSERIVELFRFHIPYYVGPIGAQGENVWAKRRPGEENGKVYPWNFEQKIDIQSAAKEFINRMVRHCTYLSGERTLPKQSFLYEKFMVLNELNNLKIDGKKPSVQVKQGIYEELFKTGKRVTLNRLKDYLYNNSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1780 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-26 effector

SEQ ID NO: 1781 - protein, 829 aa, unidentified
  REGION 1..829: note = Description of Unknown: uncultivated organism with predicted taxonomy: Butyrivibrio sp. CAG:318
  REGION 1..829: note = MG23-27 effector
MVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1782 - protein, 1366 aa, unidentified; identical to SEQ ID NO: 1777
  REGION 1..1366: note = Description of Unknown: uncultivated organism with predicted taxonomy: Butyrivibrio sp. CAG:318
  REGION 1..1366: note = MG23-28 effector

SEQ ID NO: 1783 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-29 effector

SEQ ID NO: 1784 - protein, 1366 aa, unidentified
  REGION 1..1366: note = Description of Unknown: uncultivated organism with predicted taxonomy: Butyrivibrio sp. CAG:318
  REGION 1..1366: note = MG23-30 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGNCSLIQALWETNHNLMELLSEQYGFKKELDALACNVEKPLTEWTIDDLDNKYLSAPVKRMVWQTIKMLREVCELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLREQNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDVYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTEKNIYLNNTMPLYLSWNDEEYLRKIMKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 1785 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-31 effector

SEQ ID NO: 1786 - protein, 1366 aa, unidentified
  REGION 1..1366: note = Description of Unknown: uncultivated organism with predicted taxonomy: Butyrivibrio sp. CAG:318
  REGION 1..1366: note = MG23-32 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1787 - protein, 1389 aa, unidentified
  REGION 1..1389: note = Description of Unknown: uncultivated organism with predicted taxonomy: Clostridiales
  REGION 1..1389: note = MG23-33 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSLIDSKEVMITGIDGGFKSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITSERNMKFFNTLSSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1788 - protein, 1368 aa, unidentified
  REGION 1..1368: note = Description of Unknown: uncultivated organism with predicted taxonomy: Butyrivibrio sp. CAG:318
  REGION 1..1368: note = MG23-34 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLVCGMSGVLINIYGDEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAQRRPGEEKGRVYPWNFEQKIDTQSAAKEFINRMVRHCTYLSGERTLPKQSFLYEKFMVLNELNNLRIDGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGLCECGDCSLIQALWETNHNLMELLSEQYGFKKELDALACNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAISQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPVYLGRSNALTNEDIMQYISAALQKEYAGKEISDLSVRVPFVPQKSKVRVDGFEYYLGGKTGNRICLNNAMSLYLSENDEEYLRKIMKAIEIDNYEEIDKDSNAIITEEKNVDLFDVLSVKLNSEPYINNRWNIYKTLDGKKEIFENLDIKKQCYVISQIIFWINSSTQSVNLKDVCGSEHSGMQPLNKKISECKECILIHQSVTGMYERRIDLLSI

SEQ ID NO: 1789 - protein, 1180 aa, unidentified
  REGION 1..1180: note = Description of Unknown: uncultivated organism with predicted taxonomy: Butyrivibrio sp. CAG:318
  REGION 1..1180: note = MG23-35 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDASKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYMSHV

SEQ ID NO: 1790 - protein, 1389 aa, unidentified
  REGION 1..1389: note = Description of Unknown: uncultivated organism with predicted taxonomy: Clostridiales
  REGION 1..1389: note = MG23-36 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYKEYPTIFHLRNELLHPQKDSYDVRLVYLAIANMFKHRGNFLNETLDIDKITANAVDVYSQLIEQLDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVIHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWSKLSKRFLELKGSCECGECSIIQALWQTNHNLMELMSDQYDFKTNLMELSEETIKPLSEWTIDNLEDYYMSAPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMEFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1791 - protein, 1389 aa, unidentified
  REGION 1..1389: note = Description of Unknown: uncultivated organism with predicted taxonomy: Clostridiales
  REGION 1..1389: note = MG23-37 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIDELDLYCIQMPVSIDIGKLINIIGENGISRSKRLENASKYLGITKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILVEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKGTVWSSKLAKKNPDAYMPVKTTDEKACDVKKYGGITAIANSGYTLVEYNINGKMIRSIEALPVYLGRKNMLTDDKIREYLHEKIRKEYKNKTVTDLKVCILFIPQKSKVCVDGFNYYLGGVTGNSIYLSNAEPLYLSKEDEEYLRKIIKAVDKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1792 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-38 effector

SEQ ID NO: 1793 - protein, 1366 aa, unidentified; identical to SEQ ID NO: 1784
  REGION 1..1366: note = Description of Unknown: uncultivated organism with predicted taxonomy: Butyrivibrio sp. CAG:318
  REGION 1..1366: note = MG23-39 effector

SEQ ID NO: 1794 - protein, 1366 aa, unidentified
  REGION 1..1366: note = Description of Unknown: uncultivated organism with predicted taxonomy: Butyrivibrio sp. CAG:318
  REGION 1..1366: note = MG23-40 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEDIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1795 - protein, 958 aa, unidentified
  REGION 1..958: note = Description of Unknown: uncultivated organism with predicted taxonomy: Clostridiales
  REGION 1..958: note = MG23-41 effector
MPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTVKMLNETCELTGRVPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLYEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRRNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1796 - protein, 1366 aa, unidentified
  REGION 1..1366: note = Description of Unknown: uncultivated organism with predicted taxonomy: Butyrivibrio sp. CAG:318
  REGION 1..1366: note = MG23-42 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1797 - protein, 1368 aa, unidentified
  REGION 1..1368: note = Description of Unknown: uncultivated organism with predicted taxonomy: Butyrivibrio sp. CAG:318
  REGION 1..1368: note = MG23-43 effector
MDKKMYVGIDMGTNSVGMAVTDEEYNLYRVKGKDLWCSRLFTEADTATERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1798 - protein, 1366 aa, unidentified
  REGION 1..1366: note = Description of Unknown: uncultivated organism with predicted taxonomy: Butyrivibrio sp. CAG:318
  REGION 1..1366: note = MG23-44 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKNRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLENNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1799 - protein, 1042 aa, unidentified
  REGION 1..1042: note = Description of Unknown: uncultivated organism with predicted taxonomy: Butyrivibrio sp. CAG:318
  REGION 1..1042: note = MG23-45 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIF

SEQ ID NO: 1800 - protein, 1376 aa, unidentified
  REGION 1..1376: note = Description of Unknown: uncultivated organism with predicted taxonomy: Clostridiales
  REGION 1..1376: note = MG23-46 effector
MGKNMYIGVDMGTSSDGVAVTDENYTLYRVKGKDLWTSRLFKEANTAAERRTNRVSRRRRQRETARMGILRELFSEEINKVDEGFFARLDESKYHIEDRVVKQKYALFVDKGYTDKEYYKEYPTIFHLRNELLHPQKNSYDVRLVYLAVANMFKHRGNFLNETLDIDKITANAVDVYSQLIEELDLYCIQMPVSIDIGKLINIIGENGISRSKRLENASKYLGITKKDKQSYEILKLICGLKGILYNIYGENVIDEENKKFSLSFTDSNYEDEETQAKDILGDEYFELIEIIKELYDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNYPDDDENIKNILFKIENETFMPKQLTASNGIIPNQLHAAELKAILTNAEKYLPFLLDKDESDLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIKKDMSGFWKYLCEKKFITKEKYNRLMRTDKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKICILFIPQKSKVCVDGFNYYLGGVTGNSIYLSNAEPLYLSKEDEEYLRKIIKAVGKGYYEETDENGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1801 - protein, 1366 aa, unidentified
  REGION 1..1366: note = Description of Unknown: uncultivated organism with predicted taxonomy: Butyrivibrio sp. CAG:318
  REGION 1..1366: note = MG23-47 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESDIRKNMNKFWKSLREKNFISEEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1802 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-48 effector

SEQ ID NO: 1803 - protein, 993 aa, unidentified
  REGION 1..993: note = Description of Unknown: uncultivated organism with predicted taxonomy: Clostridiales
  REGION 1..993: note = MG23-49 effector
MEINLENNAEEIIMGKKMYIGIDMGTSSVGMAVTDENYTLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKCILYNIYGENVIDEENKKFSISFTDSNYEDEETQAKDILGDEYFELIEIIKELHDICVLSGIIKGHKFLSEARVELYEEHKNDLDMLQQVLKKYDKNAYDEMFRVMKEGNYSAYVGSVNARGKNKKIRRNGGKGRSQEDFYKYVKTTLKNYPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGNDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNEICELTGRIPDKIFVEMPREHESSNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSD

SEQ ID NO: 1804 - protein, 1386 aa, unidentified
  REGION 1..1386: note = Description of Unknown: uncultivated organism with predicted taxonomy: Clostridiales
  REGION 1..1386: note = MG23-50 effector
MDRDDKKMYVGIDMGTNSVGLAVTDEKYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGQALELLGNDNFQLIEIIKELHDIGVLSSIIKGHKFLSESRVELYEEHKKDLDMLQAVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVMPNQLHTVELRAILENAEKYLPFLLNKDESGLTVSQRIVELFKFHIPYYVGPIGAGGQNVWAKRRKGEEKGRIYPWNFEQKIDTQAAAEEFIGRMVRHCTYLANERTLPKQSLLYEKYMVLNELNNMKINGIKPDVSVKQGIYNDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTVKMLREVCELTGRQPDKVFVEMPREEGIKNERKNSRKKKLLELYTSIKNEQKAWSEVKIREIDGRTETDFRIKKLYLYYLQHGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAVTQILKQAFPDTQIIFVKAGVVSDFRKKFNINKVRALNDTHHAKDAYLNIVVGNIYNTKFTSNPINFIKDARKNVNDISYKYNMDKMFDYNVCRNGENAWIADNGKSKQHVLSVLGKNSVIITRKTEENHGALSNKVTVWSKDTAKKNPGAYMPVKTTDSKAQDVTKYGGITSIASSGYTLIEYKVKGKTIRSIEALPVYLGKSDTLTEERILEYIGVNLKKEYKDKEISDIKVCVKFIPFKSKIRIDGFNYYLGGKTGNYIYLNNDEALYLNNNDEEYLRKITKAIDITNYEEIDENGNVIITQEKNTKLFNVLCEKLNNKPYRYNRWNIYNVLEGKEETFRKLDVEKQCYIINQIILWVNSAVQNINLKYINGKEHEGSLHMNKKISEYDEAVLIQQSVTGMYERKTDLLKV

SEQ ID NO: 1805 - protein, 1389 aa, unidentified
  REGION 1..1389: note = Description of Unknown: uncultivated organism with predicted taxonomy: Clostridiales
  REGION 1..1389: note = MG23-51 effector
MEINLENNAEEIIMGKKMYIGIDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVLKTINRNTVTITRKTEEVHGALSNKVTVWSSKSAEKNPDAYMPVKTTDEKAGDVTKYGGITAIANSGYTLIEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVSKGYYEETDKNGQIIITDERNMKFFNTLGSKLNARPYCNNRWNIYKIMENKEEIFAGLSIEKQCYVINQIISWINSKTQNVDLSDIKGGSHSGTMTLNKKISECSQFELIYQSVTGMYEKRTDLLKL

SEQ ID NO: 1806 - protein, 1366 aa, unidentified
  REGION 1..1366: note = Description of Unknown: uncultivated organism with predicted taxonomy: Butyrivibrio sp. CAG:318
  REGION 1..1366: note = MG23-52 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVFRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGKTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKNIYLNNAMPLYLSWNDEEYLRKIMKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 1807 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-53 effector

SEQ ID NO: 1808 - protein, 1366 aa, unidentified; identical to SEQ ID NO: 1777
  REGION 1..1366: note = Description of Unknown: uncultivated organism with predicted taxonomy: Butyrivibrio sp. CAG:318
  REGION 1..1366: note = MG23-54 effector

SEQ ID NO: 1809 - protein, 1368 aa, unidentified; identical to SEQ ID NO: 1765
  REGION 1..1368: note = Description of Unknown: uncultivated organism with predicted taxonomy: Butyrivibrio sp. CAG:318
  REGION 1..1368: note = MG23-55 effector

SEQ ID NO: 1810 - protein, 1114 aa, unidentified
  REGION 1..1114: note = Description of Unknown: uncultivated organism with predicted taxonomy: Butyrivibrio sp. CAG:318
  REGION 1..1114: note = MG23-56 effector
FFITCLCLERSERNDKNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1811 - protein, 829 aa, unidentified; identical to SEQ ID NO: 1781
  REGION 1..829: note = Description of Unknown: uncultivated organism with predicted taxonomy: Butyrivibrio sp. CAG:318
  REGION 1..829: note = MG23-57 effector

SEQ ID NO: 1812 - protein, 1366 aa, unidentified
  REGION 1..1366: note = Description of Unknown: uncultivated organism with predicted taxonomy: Butyrivibrio sp. CAG:318
  REGION 1..1366: note = MG23-58 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLAGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSRDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGNAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1813 - protein, 1389 aa, unidentified
  REGION 1..1389: note = Description of Unknown: uncultivated organism with predicted taxonomy: Clostridiales
  REGION 1..1389: note = MG23-59 effector
MEINLENNAEEIIMGKKMYIGIDMGTSSVGMAVTDENYNLYRVKGKDFWTSRLFKEASTAANRRTNRVARRRRQRELARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDVSGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQALWQTNHNLMELMSDQYDFKTNLMELSEETIRPLSEWTIDNLEDYYMSAPVKRMVWQTVKMLNETCELTGRIPDKIFVEMPREHESGNERKASRKKKLLDLYKAVKSEQKQWAEHKITEIDKRDEADFRIKKLYLYYIQHGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGVTKQHVLKTINRNTVTITRKTEEVHGALSNKVTVWSSKSAKKNPDAYMSVKTTDEKACDVTKYGGFTAIANSGYTLVEYNINGKMIRSIEALPVYLGRKNMLTDDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 1814 - protein, 1389 aa, unidentified
  REGION 1..1389: note = Description of Unknown: uncultivated organism with predicted taxonomy: Clostridiales
  REGION 1..1389: note = MG23-60 effector
MEINLENNAEEIIMGKKMYIGIDMGTSSVGMAVTDENYNLYRVKGKDFWTSRLFKEANTAAERRTNRVSRRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSISFTDSNYEDEETQAKDILGDEYFELIEIIKELHDIGVLSGIIKGHKFLSEARVELYEEHKKDLDMLQQVLKKYDKNAYDEMFRVMKEGNYSAYVGSVNARGKNKKIRRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKRFLELKGSCECGECSIIQVLWQTNHNLMELMSDQYDFKTNLMELSEETIKPLSEWTIDNLEDYYMSTPVKRMVWQTVKMLNETCELTGRVPDKIFVEMPREHESGNERKASRKKKLLDLYKAVKSEQKQWAEHKITEIDKRDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKATFVNRQLVETGQGTKVITQILKQAFPDTQVVFVKARMVSDFRHEFGINKVRELNDTHHAKDAYLNIVVGNTYNTKFTNNPINFMKNAEKNPEDVQYKYNMDKIFRYNVIRNGETAWIADNGTTKQHVIKTINRNTVTITRKTEEVHGALSNKVTVWSSKSAEKNPDAYMPVKTTDEKAGDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDKNGQIIITGERNMKFFNTLGSKLNARPYNNNRWNIYKIMDNKEEIFAGLSIEKQCYVINQIISWINSKTQNVDLSDIKGSSHSGTMTLNKKISDCSQFELIYQSVTGMYEKRTDLLKL

SEQ ID NO: 1815 - protein, 881 aa, unidentified
  REGION 1..881: note = Description of Unknown: uncultivated organism with predicted taxonomy: Clostridiales
  REGION 1..881: note = MG23-61 effector
MGKNMYIGVDMGTSSVGMAVTDENYTLYRVKGKDFWTSRLFKEANTAAERRTNRVARRRRQRETARMGILRELFSEEINKVDEGFFARLDESKYHIEDRDVKQKYALFADKGYTDKEYYQDYPTIFHLRNELLHPQKDSYDVRLVYLAIANMFKHRGNFLNETLDIDKITASADDVYSQLIEELDLYCIQMPVNINIGELINIIGENGISRSKRLENASKYLGISKKDKQSYEILKLICGLKGILYNIYGENVTDEENKKFSISFTDSNYEDEETQAKDILGDEYFELIEIIKELHDIGVLSGIIKGHKFLSEARVELYEEHKKDLDMLEQVLKKYDKNAYDEMFRVMKEGNYSAYVGSVNARGKNKKIKRNVGEGKKGKNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFTVLNELNNLKINGTKPDVFVKQDIYENLFKTGKRVTLDKLKSYLYNNSFIDSKEVMITGIDGGFNSSLTSVGKFIGILGEDLFTDSNKAMVEQIIFWGTIYGSDKKFLKNRIEKEYKDRLTPKQIKRILGFKFNGWGKLSKRFLELKGSCECGECSIIQALWQTNHNLMELMSDQYDFKTNLMEVSEKTIKPLSEWTIDNLDDYYMSAPVKRMVWQTIKMLNEICELTGRIPDKIFVEMPREHENGNERKASRKKKLLDLYKAIKSEQKQWAEQMIAEIDKRDEADFRIKKLYLYYIQQGKCMYSGDTIDLDLLLKNNNIYDIDHIYPRHFIKD

SEQ ID NO: 1816 - protein, 1368 aa, unidentified; identical to SEQ ID NO: 1788
  REGION 1..1368: note = Description of Unknown: uncultivated organism with predicted taxonomy: Butyrivibrio sp. CAG:318
  REGION 1..1368: note = MG23-62 effector

SEQ ID NO: 1817 - protein, 1366 aa, unidentified
  REGION 1..1366: note = Description of Unknown: uncultivated organism with predicted taxonomy: Butyrivibrio sp. CAG:318
  REGION 1..1366: note = MG23-63 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLETIKEIHDIGMLAGIIKGHKYLSEARVDLYEQHKKDLDMLQHVLKKYDMKAYDEMFRVMKAGNYSAYVGSVNAHSKKIRRNGGDGRTREEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSTLKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVIITVKTEEANGKLSDINIVGKRYIKNADAYMPIKTSIAKMEDVTKYGGYGSISSAGYALVEYKVKGKKVRSLEALPVYLGRSNALTNEDIMQYISAAFQKEYAGKEISDLSVRVPFIPMESKVEIDGFEYYLGGKSTNQFYLKNAMPLYLPDNDEEYFRKIMKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 1818 - protein, 1376 aa, unidentified; identical to SEQ ID NO: 1800
  REGION 1..1376: note = Description of Unknown: uncultivated organism with predicted taxonomy: Clostridiales
  REGION 1..1376: note = MG23-64 effector

SEQ ID NO: 1819 - protein, 1389 aa, unidentified
  REGION 1..1389: note = Description of Unknown: uncultivated organism with predicted taxonomy: Clostridiales
  REGION 1..1389: note = MG23-65 effector
MEINLENNAEEIIMGKKMYIGIDMGTSSVGMAVTDENYNLYRVKGKDFWTSRLFKEANTAAKRRTNRVSRRRRQRETARMGILRELFSEEINKVDEGFFARLDESKYHIEDRVVKQKYALFADKEYTDKEYYKEYPTIFHLRNELLHPQKNSYDVRLVYLAVANMFKHRGNFLNETLDIDKITASADDVYSQLIEELDLYCIQMPVNINIGELINIIGENGISRSKRLENASKYLGISKKDKQSYEILKLICGLKGILYNIYGENVIDEENKKFSLSFTDSNYEDEETQAKDILGDEYFDLIEIIKELHDIGVLSGIIKGHKFLSEARVELYEEHKKDLDMLQQVLKKYDKNAYDEMFRVMKEGNYSAYVGSVNARGKNKKIRRNVGEGKKGRNGRSQEAFYKYVKTTLKNFPDDDENIKNILFKIENETFMPKQLTASNGIIPNQLHAAEMKAILTNAEKYLPFLLDKDESGLTVSQRILELFKFHIPYYVGPLGAAGKNVWAKRRKGEEKGRIYPWNFEKKIDTQEAAEEFIKRMVRHCSYIKGEHTLPKQSLLYEKFMVLNELNNLKINGTKPDVFVKRDIYENLFKTGKRVTLDKLKSYLYNNSFIDSKEVMITGIDGGFNSSLTSVGKFIGILGEDLFTDSNQAMVEQIIFWGTIYGSDKKFLKNRIEKEYKDRLTPKQIKRILGFKFNGWGKLSKLFLELKGSCECGECSIIQALWQTNHNLMELMSDQYDFKTNLMELSEETIKPLSEWTIDNLEDYYMSAPVKRMVWQTVKMLNETCELTGRLPDKIFVEMPREHESGNERKASRKKKMLDLYKAIKSEQKQWAEHMIAEIDKSDEADFRIKKLYLYYIQQGKCMYSGDTIDLDLLLKNNNIYDIDHIYPRHFIKDDSIDNNLVLVKKEINNHKSDKYPLESDIREDMSGFWKYLCEKKFITKEKYNRLMRTEKFSAEEKAAFVNRQLVETGQGTKVITQILKQAFPDTQVVFVKARMVSDFRHEFGINKVRELNDTHHAKDAYLNIVVGNTYYTKFTNNPINFMKNAEKNPEDVQYKYNMDKIFRYNVIRNGETAWIADNGVTKQHVIKTINRNTVTITRKTEEVHGALSNKVTVWSSKLAKKNPDAYMPVKTTDEKACDVTKYGGITAIANSGYTLVEYNINGKMIRSIEALPVYLGRKNMLTEDKIKEYLHEKIRKEYKNKTVTDLKVCILFIPQKSKVCVDGFNYYLGGVTGNSIYLSNAEPLYLSKEDEEYLRKIIKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 1820 - protein, 1368 aa, unidentified
  REGION 1..1368: note = Description of Unknown: uncultivated organism with predicted taxonomy: Butyrivibrio sp. CAG:318
  REGION 1..1368: note = MG23-66 effector
MDKKMYVGIDMGTNSVGMAVTDEEYNLYRVKGKDLWCSRLFTEADTAAERRTNRISRRRRQREVARQGVLRELFAEEINKVDEGFFARLDESKYHLEDRDSEQKYTLFTDTGYTDKDYFKDYPTIFHLRNELLHPVKDSYDVRLVYLAIANMFKHRGNFLNESLDADKITSSADESYRSLVETAMMYSIEFPENINVKKFIDIIGENGVSRSKHLENVCEYLEITKKDKQAYEILKLICGMSGVLINIYGNEVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIAGKKPSVQVKQGIYEELFKTGKRVTLNKLKDYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWISDNGKTKQHVLRIMKKNSVTITVKTEEAHGALSNKVTVWSKEKAKGNPDAYMPVKTSDIKAQDVTKYGGITAIANSGYTLVEYKVKGKKVRSLEALPVYLGRSNALTNEDIMQYISAALQNEYAGKEISDLSVRVPFVPQKSKVRIDGFEYYLGGKTGKSVYLSNAMPLYLSGNDEEYLRKIMKAIEIDNYEEIDKDSNAIITEEKNVALFDVLCVKINSEPYINNRWNIYKILEGKEEIFKNLDIEKQCYIIGQIISWINSSTQNVNLKDVCGSEHSGMQQLNKKISECKECILIHQSVTGMYERRIDLLSI

SEQ ID NO: 1821 - protein, 1366 aa, unidentified; identical to SEQ ID NO: 1777
  REGION 1..1366: note = Description of Unknown: uncultivated organism with predicted taxonomy: Butyrivibrio sp. CAG:318
  REGION 1..1366: note = MG23-67 effector

SEQ ID NO: 1822 - protein, 1366 aa, unidentified
  REGION 1..1366: note = Description of Unknown: uncultivated organism with predicted taxonomy: Butyrivibrio sp. CAG:318
  REGION 1..1366: note = MG23-68 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLEITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEEYLPFLLGKDESGLTVSERIVELFRFHIPYYVGPIGAQGENVWAQRRPGEEKGRVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKREDKTWAELKIREIEGRTEADFRIKKLYLYYMQQGRCMYSGEKIELNDLFNNNLYDIDHIYPRHFIKDDSLENNLVLVKKQINNHKSDNYPLESNIRKNMNEFWKTLRDKNFISKEKYSRLIRTEEFTDEEKAAFISRQLVETRQGTKAITQILKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKKLDIKKQCYIIGQIISWINSSTQNVNLKDVCGSEHSGMQRLNKKISECKECILIHQSVTGMYERRIDLLSI

SEQ ID NO: 1823 - protein, 1366 aa, unidentified
  REGION 1..1366: note = Description of Unknown: uncultivated organism with predicted taxonomy: Butyrivibrio sp. CAG:318
  REGION 1..1366: note = MG23-69 effector
MDKKMYVGIDMGTNSVGMAVTDEEYNLYRVKGKDLWCSRLFTEADTAAERRTNRISRRRRQREVARQGVLRKLFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRSLVETAMMYSIEFPENINVKKFIDIIGENGVSRSKHLENVCEYLGITKKDKQAYEILKLICGMSGVLINIYGEDVIDEENKKFSICFRDSNYEEKEGEALELLGDEYFELLEAIKEIHDIGMLAGIIKGHKYLSEARVDLYEQHKKDLDMLQHVLKKYDMKAYDEMFRVMKAGNYSAYVGSVNAHSKKIRRNGGDGRTQEEFYKNVKAVLKKFPEDDEEIKTILSEIDSETFMPKQLTASNGVIPNQLHVSELKAILTNAEKYLPFLLGKDESGLTVSERIVELFRFHIPYYVGPIGAQGENVWAKRRSGEENGKVYPWNFEQKIDTQSAAKEFINRMVRHCTYLSGERTLPKQSLLYEKFMVLNELNNLKIAGKKPSVQVKQDIYEKLFKLGKKVTLKQLEEYLCNNSIIASKEDIEGIDGGFNSSLTSVGKFRGVLGDELFTDANQAMAEEIIFWGTVYGNDKKFLKDEIESKYGTVVSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKEINNHKSDNYPLESDIRKNMNKFWKSLRDKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLRIMKKNSVTITVKTEEYHGALSNKVTVWSKEKAKGNPDAYMPVKTSDTKAQDVTKYGGITSIANSGYTLVEYKVKGKKVRSLEALPAYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 1824 - protein, 1368 aa, unidentified
  REGION 1..1368: note = Description of Unknown: uncultivated organism with predicted taxonomy: Butyrivibrio sp. CAG:318
  REGION 1..1368: note = MG23-70 effector
MDKKMYVGIDMGTNSVGMAVTDEEYNLYRVKGKDFWCSRLFKKANTAAERRTNRISRHRRQREVARQGVLRELFADEINKVDEGFFARLDESKYHLEDRDSEQKYTLFTDTGYTDKDYFKDYPTIFHLRNELLHPVKDSYDVRLVYLAIANMFKHRGNFLNESLDADKITSSADEAYRRLVETAMMYSIEFPENINVKKFIDIIGENGVSRSKHLGNVCEYLGITKKDKPAYEILNLVCGLRGVLINIYGNEVIDEENKKFSICFRDSNYEEKEGEALELLGDEYFELLETIKEIHDIGMLTGIIKGHKYLSEARVDLYKQHKKDLDMLQHVLKKYDMKAYDEMFRVMKAGNYSAYVGSVNAHSKKIRRNGGDGRTREDFYKNVKAVLKKFPEDDEEIKTILSEIDSETFMPKQLTASNGVIPNQLHVSELKAILTNAEKYLPFLLDKDESGLTVSERIVELFRFHIPYYVGPIGAQGENVWAKRRPGEENGKVYPWNFEQKIDTQSAAKEFINRMVRHCTYLSGERTLPKQSFLYEKFMVLNELNNLRIDGKKPSVQVKQGIYEELFKTGKRVTLNQLIKYLYNKSIIASKEDVVIEGIDGGFNASLTSVGKFRGVLGDELFTDANQAMAEEIIFWGTVYGNDKKFLKDEIESKYGTVLSKDQIKRILGFKFNGWGNLSKTFLELQGSCECGDCSLIQALWETNHNLMELLSEQYGFKKELDALASNVEKPLTEWTIDDLDNKYLSAPVKRMVWQTIKMLREACELTNKEPDRVFVEMPREHGKENDRKASRKKKLLDLYSALKRENKTWAELKIREIEGKTEADFRIKKLYLYYMQQGKCMYSGEKIELNDLFNNNLYDIDHIYPRHFIKDDSLENNLVLVKKQINNHKSDNYPLESNIRKNMNEFWKTLREKNFISKEKYSRLIRTEEFTDEEKAAFISRQLVETRQGTKAITQVLKQAFPNTQIVFVKAGIVSDFRKKFDINKVRALNDTHHAKDAYLNIVVGNTYYTKFTNNPMNFIKDARKNPKNDFYRYNMDKIFDYNVIRNGEEAWIADNGKTKQHVLQIMKKNSVTITVKTEEYHGALSNKVTVWSKEKAKGNPDAYMPVKTSDTKAQDVTKYGGITAIANSGYTLVEYKVKGKKVRSLEALPVYLGRSNALTNEDIMQYISAALQKEYAGKEISDLSVRVPFVPQKSKVRVDGFEYYLGGKTGKSVYLSNAMPLYLSGNDEEYLRKIMKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 1825 - protein, 774 aa, unidentified
  REGION 1..774: note = Description of Unknown: uncultivated organism with predicted taxonomy: Butyrivibrio sp. YAB3001
  REGION 1..774: note = MG23-71 effector
GNFLNESLSTNSNSVSISDAYQNLVEIANLFDISFPANIDVTKLQDILSDRTTSKRVKLEQLVELMGIVKKASPAEYELLQMCCGMKGKLSNIFGEVISEEDKAFSFSFSDSKYEENAGKALELVGDEYYEIIDAVKEVYDIGLLANIMKGEKYLSDARVADYKAHKKDLALLKQVIREYAEDEYDNFFRKMDEGNYSAYVGSVNSKLEKIRRNGNKGRSQEDLYKTIQTIIKNMREEDKEDSRVKEILSKIEAGSFLPKQLTGSNGVIPNQVHEREMKQILENASTYLPFLREKDESGLSVAERILKMFTFHIPYYIGPLGQEHLDENGYNVWARRIAPGPIYPWNIEEKIDVNEAAEKFITRMLRKCTYIQDEQALPKQSLLYEKFMVLNELNNLRIFGEKISVEVKQNIFNELFMKGKKVTRDNLIKYLVASGVISKNESAEEAISGVDGDFKSYLSSVNKFESIFGKESIYGSKREMIEKIIFWGTVFGKDKRIIKEKLKKEYGSELSDDVIKRIAGFNFSGWGNLSEELLEMPGSCGTDEEEKSIIICLWETNENLMELLGSSHTFKKEIENRIATQNKELMEWTIEDLDGMYLSPSVKRRVWQTLKVLKEIYQVTGGEPEKIFVEMPREEGEKGKRTESRKKKLEFLYKGQKQFLQEIGKRDERDFRQKKLYLYYLQNGKSMYTGNEIDLDELLSNNSKYDIDHIYPRHYIKDDSLDNNLVLVEKEINNDIKGGDYPISKTIQSKMRSFWKELQEKGFITSEKYNRLV

SEQ ID NO: 1826 - protein, 1386 aa, unidentified
  REGION 1..1386: note = Description of Unknown: uncultivated organism with predicted taxonomy: Eubacterium
  REGION 1..1386: note = MG23-72 effector
MDRDDKKMYVGIDMGTNSVGLAVTDENYNLYRVKGKDFWCSRIFSKAETAEVRRVNRISRRRRQRETARQGILREFFAEEINKVDEGFFARLDESKYHIEDRENQQKYTLFIDNGYTDKEYYAEYPTIFHLRNELLHPQKDSYDVRLVYLAISNMFKHRGNFLNETLDMGKVTSSAGDIYQQLVEEAMLYVIELPVSIDVERLINIIGEKGVSRSKHLENVSSYLGITKKDKSAYEILKLVCGMSGLLFNIYGEEIIDEENKKFSLNFRDTNYEEKEGKALELLGNDNFQLIEIIKELHDIGVLSSIIKGHKFLSESRVELYEEHKKDLDMLQVVLKRYDKKAYNDMFRIMKEGNYSAYVGSVNSIGQNEKRSEKCQKQKIRRNRGKGSSQEVFYKYVKSVLKKLPEDDKDVKKIMEKIENETFMPKQLTASNGVIPNQLHTVELRAILENAEKYLSFLLNKDESGLTVSQRIVELFKFHIPYYVGPIGASGQNVWAKRRKGEEKGRIYPWNFEQKIDTQAAAEEFIGRMVRHCTYLANERTLPKQSLLYEKYMVLNELNNMKINGIKPDVSVKQGIYDDLFKKGKRVTLNALKSYLYNNSIIESKEDVVITGIDIVHNGGFSASLTSVGKFIGVLGDELFTDENQTMVEQIIFWGTVYGNDKKFLKNRIQETYAGRLTWEQIKRIAGFKFNGWGNLSKAFLELKGNCECGECSIIQALWETNHNLMELLADQYDFKKNLEAMSNNVEKPLQEWTIEDLEGKYLSAPVKRMVWQTMKMLREVCELTGRQPDKVFVEMPREEGIKNERKNSRKKKLLELYTSIKNEQKAWSEVKIREIDGRTETDFRIKKLYLYYLQQGKCMYSGEKIELNDLFNNNLYDIDHIYPRHFIKDDSIENNLVLVKKQINNHKSDTFPIESSIQKNMMTFWKTLVEHNFITKEKYNRLMRTEEFTDEEKAAFISRQLVETRQGTKAITQILKQAFPDTQIIFVKAGVVSDFRKKFNINKVRALNDTHHAKDAYLNIVVGNIYNTKFTSNPINFIKDARKNVNDVSYKYNMDKMFDYNVCRNGENAWIADNGKSKQHVLSVLGKNSVIITRKTEENHGALSNKVTVWSKETAKKNPGAYMPVKTTDSKAQDVTKYGGITSVASSGYTLIEYKVKGKIIRSIEALPVYLGKSDTLTEEKILEYIGESLEKEYKDKKISDIKVRVKFIPLKSKIRLDGFNYYLGGKTGNYIYLNNNEALYLNNNDEEYLRKITKAIDITNYEEIDENGNVIITHEKNTKLFNVLCEKLNNKPYINNRWNIYNVLEGKEEIFRKLDVEKQCYIINQIILWGNSAVQNINLKYINGKEHEGSLLMNKKISEYDEVVLIQQSVTGMYERKTDLLKV

SEQ ID NO: 1827 - protein, 114 aa, unidentified
  REGION 1..114: note = Description of Unknown: uncultivated organism with predicted taxonomy: Candidatus Melainabacteria
  REGION 1..114: note = MG1-4 RuvC-III domain
AETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDK

SEQ ID NO: 1828 - protein, 142 aa, unidentified
  REGION 1..142: note = Description of Unknown: uncultivated organism with predicted taxonomy: Verrucomicrobia
  REGION 1..142: note = MG1-5 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLAEVVPTKVAIKK

SEQ ID NO: 1829 - protein, 140 aa, unidentified
  REGION 1..140: note = Description of Unknown: uncultivated organism with predicted taxonomy: unclassified Verrucomicrobia (miscellaneous)
  REGION 1..140: note = MG1-6 RuvC-III domain
AETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1830 - protein, 140 aa, unidentified
  REGION 1..140: note = Description of Unknown: uncultivated organism with predicted taxonomy: unclassified Verrucomicrobia (miscellaneous)
  REGION 1..140: note = MG1-7 RuvC-III domain
AETAHISKLAQKIVCLHFGFQFGGLSGTKRVFTVPGALTARIRTFYGLNKILHNEDLAHETLSFEGFLKRGEELDKKNRANKKHHALDAMCLCFAPTGVNSKRARVDMLLPPKIRSEKEAELFFRKYLDKLIPVDVAPKK

SEQ ID NO: 1831 - protein, 137 aa, unidentified
  REGION 1..137: note = Description of Unknown: uncultivated organism
  REGION 1..137: note = MG1-1 RuvC-III domain
AETAWISKLAQAIVNLQFGWTNGYDEKRERRVIVVSGGLTARVRRKYGLDKLLYNDVTDLEVLAKKVKNRDDKRHHALDAMVMTFIPQWARNPDQEGFFRFPREFRDASGREDYQKVRQLFAKHLSEVMPTNIAFER

SEQ ID NO: 1832 - protein, 127 aa, unidentified
  REGION 1..127: note = Description of Unknown: uncultivated organism with predicted taxonomy: Verrucomicrobia
  REGION 1..127: note = MG1-2 RuvC-III domain
AETAWISKLAQTILNLKFGWTNGNTPDGRKAVVVVPGGLTARIRRKYSLNSLLAGDGVDEEEAEKKNRKDHRHHALDAMVISFLPGWVANPDKEHFFRFPEPVRANPRGFFQTAIHNVVPRQLCFEK

SEQ ID NO: 1833 - protein, 137 aa, unidentified
  REGION 1..137: note = Description of Unknown: uncultivated organism
  REGION 1..137: note = MG1-3 RuvC-III domain
QLARQLRAEIMRWMQVDDKPDEAARRIGTPSGWLAAQARKSWLPAEEYEKVRNNVTHHLIDAAILAHIPPREGMNSVRCKGIFYVESVPVRDPVTGDTTYRLETKALPELSPLPRLKHWLPDNGEYDVCPVWKPRRQ

SEQ ID NO: 1834 - protein, 137 aa, unidentified; identical to SEQ ID NO: 1833
  REGION 1..137: note = Description of Unknown: uncultivated organism
  REGION 1..137: note = MG1-13 RuvC-III domain

SEQ ID NO: 1835 - protein, 140 aa, unidentified
  REGION 1..140: note = Description of Unknown: uncultivated organism
  REGION 1..140: note = MG1-8 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPNKQGFFRFPPAFRDANGREDYQQIQSLFARQLEKIVPRHLAYEP

SEQ ID NO: 1836 - protein, 176 aa, unidentified
  REGION 1..176: note = Description of Unknown: uncultivated organism with predicted taxonomy: Verrucomicrobia
  REGION 1..176: note = MG1-9 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRTKEDFFRFPTAIGDNDFYSKEDQPEMAAIKSQLAKLYVENKPVFR

SEQ ID NO: 1837 - protein, 138 aa, unidentified
  REGION 1..138: note = Description of Unknown: uncultivated organism
  REGION 1..138: note = MG1-10 RuvC-III domain
QLASQLRKQVAFWLGIHADSDDLSAAVALRERIGNPQGQYTAAMRRSLLPESGKDRSGYVHHREDAALLSCMPPMGLNSIKYKGIFYTKMVPWLDSSGQLQQRRSLFALSCADGLPLPDIASILEDDTECPIIKRRSE

SEQ ID NO: 1838 - protein, 123 aa, unidentified
  REGION 1..123: note = Description of Unknown: uncultivated organism
  REGION 1..123: note = MG1-11 RuvC-III domain
QLARELRRYIAVWMGINRDVDAVRERIGNPCGSYTAAARRGMLPADYRKDRSNNLHHRIDAAVLTCIPPAAGLNNLRCGGIFRNTRINGKRCTTTIPGLPLPDFGALIADDSTCPLVSRRRTG

SEQ ID NO: 1839 - protein, 125 aa, unidentified
  REGION 1..125: note = Description of Unknown: uncultivated organism
  REGION 1..125: note = MG1-12 RuvC-III domain
QLARQLREEAARWLGVFGDDAKVRQKIGTPTGYQTSVCREAWSENVPKKDRTNLRHHLWDAAVISHIPPDRGMQLSHCGGIFFHAGEKKNGNILMRALPGLGPDLNSFENATKDQCLVEKKKTNR

SEQ ID NO: 1840 - protein, 137 aa, unidentified; identical to SEQ ID NO: 1831
  REGION 1..137: note = Description of Unknown: uncultivated organism
  REGION 1..137: note = MG1-14 RuvC-III domain

SEQ ID NO: 1841 - protein, 130 aa, unidentified
  REGION 1..130: note = Description of Unknown: uncultivated organism
  REGION 1..130: note = MG1-20 RuvC-III domain
AVTGWVARMARDIACLWFGWEPGAEGEQRKLHTVSGSLVGKVRRKFGLNKALNPFLSAADAKKDEKNREDKRHHALDAMVMTYLDEYMRNPRNFSKLQKELGEIFGKLGGAQYFEEKLEDVIPHKIARNK

SEQ ID NO: 1842 - protein, 130 aa, unidentified; identical to SEQ ID NO: 1841
  REGION 1..130: note = Description of Unknown: uncultivated organism with predicted taxonomy: Candidatus Peregrinibacteria bacterium CG10_big_fil_rev_8_21_14_0_10_54_7
  REGION 1..130: note = MG1-21 RuvC-III domain

SEQ ID NO: 1843 - protein, 130 aa, unidentified; identical to SEQ ID NO: 1841
  REGION 1..130: note = Description of Unknown: uncultivated organism with predicted taxonomy: Candidatus Peregrinibacteria bacterium CG10_big_fil_rev_8_21_14_0_10_54_7
  REGION 1..130: note = MG1-22 RuvC-III domain

SEQ ID NO: 1844 - protein, 114 aa, unidentified
  REGION 1..114: note = Description of Unknown: uncultivated organism with predicted taxonomy: Candidatus Melainabacteria bacterium
  REGION 1..114: note = MG1-23 RuvC-III domain
AETAQIARIAQQITALVFNWGLQVEGENRHIFVNNGSSTASIRRTYKLNKLLGDDVKKNRDNDKHHALDAICISFSRDYKYNKEKKVDEIEGLNPEIIKEVINNLMPYPYANDK

SEQ ID NO: 1845 - protein, 114 aa, unidentified
  REGION 1..114: note = Description of Unknown: uncultivated organism
  REGION 1..114: note = MG1-24 RuvC-III domain
AETAYIARVAQQITAFCFGWGLQVEGEKRHIFVNNGSSTHAIRRRYGLNSLLGNDIKKNRDNDKHHALDAICISFSRDFKYDEKSKVDVIDGFTKEMVKKVLDEIIPYPYTNKK

SEQ ID NO: 1846 - protein, 120 aa, unidentified
  REGION 1..120: note = Description of Unknown: uncultivated organism
  REGION 1..120: note = MG1-25 RuvC-III domain
AETAQIARVAQDITAFVFGWGLQLEGEKRRIFVNNGATTSAIRKTYRLNKLLGNDVKKNRQNDKHHALDAICISFSRGYKYNATTKRDEIEGLDIHDNEFRDLVKSSIDSLLPYPYSNDK

SEQ ID NO: 1847 - protein, 114 aa, unidentified
  REGION 1..114: note = Description of Unknown: uncultivated organism
  REGION 1..114: note = MG1-26 RuvC-III domain
AETSHIARVAQQMTAFIFGWGLQVQGKNRRIFVNNGSSTCAIRKRYDLNKLLGDDRKKNRENDKHHALDAICISFSRDFKYDKEIKKDIIKGFNPEIVKDAIDKIMPYPYANDK

SEQ ID NO: 1848 - protein, 120 aa, unidentified
  REGION 1..120: note = Description of Unknown: uncultivated organism
  REGION 1..120: note = MG1-27 RuvC-III domain
AETAQIARVAQDITAFIFGWGLQLKDEKRRIFVNNGASTSGIRKTYRLNKLLGNDVKKNRNNDKHHALDAICISFSQNYKYNKHTKRDEIEGLDIHDNEFRELIKQTLDAIIPYPYTNDK

SEQ ID NO: 1849 - protein, 114 aa, unidentified
  REGION 1..114: note = Description of Unknown: uncultivated organism
  REGION 1..114: note = MG1-28 RuvC-III domain
AETAHIAKVAQQIAAVCFSWGLQIEGEKRHIYVNNGSSTHAIRHRYGLNSLLGNDIKKNRDNDKHHALDAICISFSRDFKYDEESKKDIIKGFTREMVKKVIDEIMPVPYTNKK

SEQ ID NO: 1850 - protein, 114 aa, unidentified; identical to SEQ ID NO: 1845
  REGION 1..114: note = Description of Unknown: uncultivated organism
  REGION 1..114: note = MG1-29 RuvC-III domain

SEQ ID NO: 1851 - protein, 114 aa, unidentified; identical to SEQ ID NO: 1849
  REGION 1..114: note = Description of Unknown: uncultivated organism
  REGION 1..114: note = MG1-30 RuvC-III domain

SEQ ID NO: 1852 - protein, 120 aa, unidentified
  REGION 1..120: note = Description of Unknown: uncultivated organism
  REGION 1..120: note = MG1-31 RuvC-III domain
AETAQIARVAQDITAFIFSWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1853 - protein, 120 aa, unidentified
  REGION 1..120: note = Description of Unknown: uncultivated organism
  REGION 1..120: note = MG1-32 RuvC-III domain
AETAQIARVAQDITAFIFGWGLQLKDEKRRIFVNNGASTSGIRKTYRLNKLLGNDVKKNRSNDKHHALDAICISFSQNYKYNKYTKRDEIEGLDIHDNEFRELIKQTLDAIIPYPYTNDK

SEQ ID NO: 1854 - protein, 120 aa, unidentified; identical to SEQ ID NO: 1852
  REGION 1..120: note = Description of Unknown: uncultivated organism
  REGION 1..120: note = MG1-33 RuvC-III domain

SEQ ID NO: 1855 - protein, 114 aa, unidentified; identical to SEQ ID NO: 1847
  REGION 1..114: note = Description of Unknown: uncultivated organism with predicted taxonomy: Candidatus Gastranaerophilales bacterium HUM_9
  REGION 1..114: note = MG1-34 RuvC-III domain

SEQ ID NO: 1856 - protein, 120 aa, unidentified; identical to SEQ ID NO: 1846
  REGION 1..120: note = Description of Unknown: uncultivated organism
  REGION 1..120: note = MG1-35 RuvC-III domain

SEQ ID NO: 1857 - protein, 115 aa, unidentified
  REGION 1..115: note = Description of Unknown: uncultivated organism with predicted taxonomy: Clostridium
  REGION 1..115: note = MG1-36 RuvC-III domain
EDTQYIAKWITNYIRRNIQFVECSKYNNKVLIISSNLTSYINRKLDISNNIIIGNQKHALDALVTATVSKELLNKIIIYSRENTENSQFPIPWENFKQDMNNLPPIFVSRAPKRK

SEQ ID NO: 1858 - protein, 120 aa, unidentified; identical to SEQ ID NO: 1846
  REGION 1..120: note = Description of Unknown: uncultivated organism
  REGION 1..120: note = MG1-37 RuvC-III domain

SEQ ID NO: 1859 - protein, 114 aa, unidentified; identical to SEQ ID NO: 1844
  REGION 1..114: note = Description of Unknown: uncultivated organism with predicted taxonomy: Candidatus Melainabacteria bacterium
  REGION 1..114: note = MG1-38 RuvC-III domain

SEQ ID NO: 1860 - protein, 120 aa, unidentified; identical to SEQ ID NO: 1852
  REGION 1..120: note = Description of Unknown: uncultivated organism
  REGION 1..120: note = MG1-39 RuvC-III domain

SEQ ID NO: 1861 - protein, 120 aa, unidentified; identical to SEQ ID NO: 1853
  REGION 1..120: note = Description of Unknown: uncultivated organism
  REGION 1..120: note = MG1-40 RuvC-III domain

SEQ ID NO: 1862 - protein, 114 aa, unidentified; identical to SEQ ID NO: 1847
  REGION 1..114: note = Description of Unknown: uncultivated organism with predicted taxonomy: Candidatus Gastranaerophilales bacterium HUM_9
  REGION 1..114: note = MG1-41 RuvC-III domain

SEQ ID NO: 1863 - protein, 120 aa, unidentified; identical to SEQ ID NO: 1848
  REGION 1..120: note = Description of Unknown: uncultivated organism
  REGION 1..120: note = MG1-42 RuvC-III domain

SEQ ID NO: 1864 - protein, 120 aa, unidentified; identical to SEQ ID NO: 1852
  REGION 1..120: note = Description of Unknown: uncultivated organism
  REGION 1..120: note = MG1-43 RuvC-III domain

SEQ ID NO: 1865 - protein, 114 aa, unidentified; identical to SEQ ID NO: 1849
  REGION 1..114: note = Description of Unknown: uncultivated organism
  REGION 1..114: note = MG1-44 RuvC-III domain

SEQ ID NO: 1866 - protein, 114 aa, unidentified; identical to SEQ ID NO: 1847
  REGION 1..114: note = Description of Unknown: uncultivated organism with predicted taxonomy: Candidatus Melainabacteria
  REGION 1..114: note = MG1-45 RuvC-III domain

SEQ ID NO: 1867 - protein, 114 aa, unidentified; identical to SEQ ID NO: 1849
  REGION 1..114: note = Description of Unknown: uncultivated organism
  REGION 1..114: note = MG1-46 RuvC-III domain

SEQ ID NO: 1868 - protein, 120 aa, unidentified; identical to SEQ ID NO: 1848
  REGION 1..120: note = Description of Unknown: uncultivated organism
  REGION 1..120: note = MG1-47 RuvC-III domain

SEQ ID NO: 1869 - protein, 114 aa, unidentified
  REGION 1..114: note = Description of Unknown: uncultivated organism
  REGION 1..114: note = MG1-48 RuvC-III domain
AETAQIARVAQQLAAFIFGWGMQTEGDKRHLFINNGSTTAAIRRRYGLNKLLGDDIKKNRENDKHHALDAICISFSKDFKYDHKSKKDIIEGFTYDFVKNEIDKLIPYPYANDK

SEQ ID NO: 1870 - protein, 114 aa, unidentified
  REGION 1..114: note = Description of Unknown: uncultivated organism
  REGION 1..114: note = MG1-49 RuvC-III domain
NETTQIAKIVQSVTASVLEWDLQVKDKNRHIFISDGSSTHKIRQQYKLDRLLDDNAKKNRENGKHRALDAICISYSKDFQYNTEQHKYEIENIDIPHIEDVINHVVPYPYTNDK

SEQ ID NO: 1871 - protein, 114 aa, unidentified; identical to SEQ ID NO: 1870
  REGION 1..114: note = Description of Unknown: uncultivated organism
  REGION 1..114: note = MG1-50 RuvC-III domain

SEQ ID NO: 1872 - protein, 114 aa, unidentified
  REGION 1..114: note = Description of Unknown: uncultivated organism with predicted taxonomy: Candidatus Melainabacteria bacterium
  REGION 1..114: note = MG1-51 RuvC-III domain
ADTAQIAKVAQQLAAFIFGWGMQTDGDKRHLFVNNGSTTAAIRRRYGLNKILGNDIKKNRENDKHHALDAICISFSQDFKYDPKSQKDIINGFTYDFVKNEIDKLIPYPYANNK

SEQ ID NO: 1873 - protein, 114 aa, unidentified
  REGION 1..114: note = Description of Unknown: uncultivated organism
  REGION 1..114: note = MG1-52 RuvC-III domain
AETAQIARVAQQLAAFIFGLGMQTEGDKRHLFVNNGSTTAAIRRRYGLNKLLGDDVKKNRENDKHHALDAICISFSRDFKYDEKSKKDVIEGFTYDFVKKAIDELIPYPYANDK

SEQ ID NO: 1874 - protein, 114 aa, unidentified; identical to SEQ ID NO: 1870
  REGION 1..114: note = Description of Unknown: uncultivated organism
  REGION 1..114: note = MG1-53 RuvC-III domain

SEQ ID NO: 1875 - protein, 114 aa, unidentified; identical to SEQ ID NO: 1870
  REGION 1..114: note = Description of Unknown: uncultivated organism
  REGION 1..114: note = MG1-54 RuvC-III domain

SEQ ID NO: 1876 - protein, 114 aa, unidentified; identical to SEQ ID NO: 1870
  REGION 1..114: note = Description of Unknown: uncultivated organism
  REGION 1..114: note = MG1-55 RuvC-III domain

SEQ ID NO: 1877 - protein, 114 aa, unidentified
  REGION 1..114: note = Description of Unknown: uncultivated organism
  REGION 1..114: note = MG1-56 RuvC-III domain
AETAHIARVAQQITAFIFDWGLQLEGENRHIFVNNGSSTCAIRKRYHLNSLLGDDEKKNRSNDKHHALDAICISYSRDFKYDKNIKKDTIEEFNPEVVKKVIDEIIPYPYANKK

SEQ ID NO: 1878 - protein, 114 aa, unidentified
  REGION 1..114: note = Description of Unknown: uncultivated organism
  REGION 1..114: note = MG1-57 RuvC-III domain
NETAQIAKVAQSITAFILGWGLQVKGENRHIFVNNGSSTHKIRQQFKLNRLLGNDEKKNRENDKHHALDAICISYSKDFRYNTEKHKYEIDNLDIPHIEEVINSIVPYPYTNDK

SEQ ID NO: 1879 - protein, 114 aa, unidentified
  REGION 1..114: note = Description of Unknown: uncultivated organism with predicted taxonomy: Candidatus Termititenax aidoneus
  REGION 1..114: note = MG1-58 RuvC-III domain
AETAQIARVAQEITAFVFGWGMQTSGDDRHIFVNNGSSTSAIRRRYGLNKILGDDVKKNRENDKHHALDAICISFSRDFKYDEHSKKDVIKGFTYDFVKKEIDKLMPYPYANDK

SEQ ID NO: 1880 - protein, 141 aa, unidentified
  REGION 1..141: note = Description of Unknown: uncultivated organism with predicted taxonomy: Verrucomicrobia
  REGION 1..141: note = MG1-59 RuvC-III domain
AETAWISKLAQRICCLHFGFQFGGLTGAKKVWTVSGNTTAMIRGRYGLNRLLHDEESAADSLFDRICMEKKFEEKNRKNKKHHALDAMCLCFAPTSNAKKASAYKNILPEEITRNPESDEARKFFGKYLANVIPNKVAVEK

SEQ ID NO: 1881 - protein, 140 aa, unidentified
  REGION 1..140: note = Description of Unknown: uncultivated organism with predicted taxonomy: unclassified Verrucomicrobia (miscellaneous)
  REGION 1..140: note = MG1-60 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1882 - protein, 129 aa, unidentified
  REGION 1..129: note = Description of Unknown: uncultivated organism
  REGION 1..129: note = MG1-61 RuvC-III domain
AETAYIAKMSQKIAHLFFGWSQGTLGSKKKVIVANGSLTAKMRGLYGLNRILHSGISEEEYKELVKSGKIDEKNRDNPRHHALDAIVLSMLPEIQMNDRKKDFFPIWFTPDYCRENLEKCFPKHIKYEK

SEQ ID NO: 1883 - protein, 129 aa, unidentified; identical to SEQ ID NO: 1882
  REGION 1..129: note = Description of Unknown: uncultivated organism with predicted taxonomy: Deltaproteobacteria
  REGION 1..129: note = MG1-62 RuvC-III domain

SEQ ID NO: 1884 - protein, 176 aa, unidentified
  REGION 1..176: note = Description of Unknown: uncultivated organism with predicted taxonomy: Verrucomicrobia bacterium 61-8
  REGION 1..176: note = MG1-63 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRTKEDFFRFPTAIGDNDFYSKEDQPEMAAIKSELAKLYVENKPVFR

SEQ ID NO: 1885 - protein, 176 aa, unidentified
  REGION 1..176: note = Description of Unknown: uncultivated organism
  REGION 1..176: note = MG1-64 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSELAKLYVENKPVFR

SEQ ID NO: 1886 - protein, 179 aa, unidentified
  REGION 1..179: note = Description of Unknown: uncultivated organism with predicted taxonomy: Verrucomicrobia
  REGION 1..179: note = MG1-65 RuvC-III domain
ATTATIARMALRITDILFDWQNGNDAQGNKRVRVFPGGRTAAIRRRYLLNTLLGADSDQKLKTITDLQSEISQIKAQWPSLQGEEHKPTRKAYYQKRRQLAELIEGTKKDRSDARHHALDAMVLTFLPTWAQHPNKDEFFRFPPPLDNPYPQRPDILKVHQFFRDALNNVIPTPLAFEK

SEQ ID NO: 1887 - protein, 129 aa, unidentified
  REGION 1..129: note = Description of Unknown: uncultivated organism
  REGION 1..129: note = MG1-66 RuvC-III domain
AETSYISRLAQKIVHLYFGWEQLTKGSSRRVFVVSGAFTKRIRDLFKLDAILYPDLTLEEVYKYSAEEREEKNRNNPRHHALDALVVSITQEIKYNPLKGKDEYPEWFTPEFCKQAVERCLPVKVRFEK

SEQ ID NO: 1888 - protein, 176 aa, unidentified
  REGION 1..176: note = Description of Unknown: uncultivated organism
  REGION 1..176: note = MG1-67 RuvC-III domain
AESAWIARLAQTIARLHFGWPLDDEPGEERVITISGGLTARIRRKYLLDSLLGVGNDAETLRREIDSALDELEALRTDTSLSENARKQKRAELRQRLANLAAEAEKNRDDQRHHALDAMLLTFLPNWARDRNKEDFFRFPTAIGDNDLYSKEDQPKIEAIKSKLAKLYEENGAVFR

SEQ ID NO: 1889 - protein, 129 aa, unidentified
  REGION 1..129: note = Description of Unknown: uncultivated organism with predicted taxonomy: Elusimicrobia bacterium HGW-Elusimicrobia-1
  REGION 1..129: note = MG1-68 RuvC-III domain
AETAYIAKLSQKICHLFFGWEQGTEGSKRKVIVANGGLTAKMRNAYDLNRILHTGLSDAEYKELCKSGEIDKKNRDNPRHHALDAMVISMIPEIKMNDRKKDFFPIWFNPDYCREKLEQCFPKNIRYEK

SEQ ID NO: 1890 - protein, 140 aa, unidentified
  REGION 1..140: note = Description of Unknown: uncultivated organism with predicted taxonomy: Pedosphaera sp. Tous-C6FEB
  REGION 1..140: note = MG1-69 RuvC-III domain
AETAWISKLAQTIVNLRFGWRNGVDYSGPQPVKRVIVVSGGLTARVRRKYGLDKLLYGEDTAPEVLAKKVKNRDDDRHHALDAMVMTFIPHWARDPNKQGFFRFPPAFRDANGREDYQRIRSLFASHLQQIVPRHLAYEP

SEQ ID NO: 1891 - protein, 123 aa, unidentified
  REGION 1..123: note = Description of Unknown: uncultivated organism with predicted taxonomy: Endomicrobium
  REGION 1..123: note = MG1-70 RuvC-III domain
AETSYISRLAQRIVHLFFGWEQLTKGSTRHVYVVSGALTKYIRDKFELDVLLYPDLTKEEVFKIPSEEREEKNRNNPRHHALDALVVSIARPENVDKYPEWFTQDFCRMAIEKCLPVKVRFEK

SEQ ID NO: 1892 - protein, 179 aa, unidentified; identical to SEQ ID NO: 1886
  REGION 1..179: note = Description of Unknown: uncultivated organism
  REGION 1..179: note = MG1-71 RuvC-III domain

SEQ ID NO: 1893 - protein, 105 aa, unidentified
  REGION 1..105: note = Description of Unknown: uncultivated organism with predicted taxonomy: Deltaproteobacteria
  REGION 1..105: note = MG1-72 RuvC-III domain
AETAWISKLAQTIVNLRFGWRNGVDYSGPQPVKRVIVVSGGLTARVRAKYGLDKLLYGENTPPEVLAKKVKNRDDDRHHALDAMVMTFIPHWARDPHKEGFFRFP

SEQ ID NO: 1894 - protein, 176 aa, unidentified
  REGION 1..176: note = Description of Unknown: uncultivated organism with predicted taxonomy: Pedosphaera sp. Tous-C6FEB
  REGION 1..176: note = MG1-73 RuvC-III domain
AESAWIARLAQTIARLHFGWPLDDEPGEERVITISGGLTARIRRKYLLDSLLGVGNDAETLRREIDSALNELQALRTDTSLSENAPKQKRAELRQRLANLAAEAEKNRDDQRHHALDAMLLTFLPNWARDRNKEDFFRFPTAIGDNDFYSKEDQPEMAAIKSQLAKLYVENKPVFR

SEQ ID NO: 1895 - protein, 179 aa, unidentified; identical to SEQ ID NO: 1886
  REGION 1..179: note = Description of Unknown: uncultivated organism
  REGION 1..179: note = MG1-74 RuvC-III domain

SEQ ID NO: 1896 - protein, 83 aa, unidentified
  REGION 1..83: note = Description of Unknown: uncultivated organism
  REGION 1..83: note = MG1-75 RuvC-III domain
QLARQLVAECAHWMGIAGDPDEIQRRIGTPSGYMRAQALRSWEDTVPAKNRSDLVHHLVDAAVVAHIPPGAGMNQVSYGGIFY

SEQ ID NO: 1897 - protein, 130 aa, unidentified
  REGION 1..130: note = Description of Unknown: uncultivated organism
  REGION 1..130: note = MG1-76 RuvC-III domain
AETAYISRLAQKICHLFFGWEQLTKGSQRKVFVVSGAFTRKIRTIFELDRILYPDLSDEEYKELLTKGEIQKKNRDNPRHHVLDTIVLSIIPEIKYNPEREKDDYPVWFNKEYCRQYIEKCFPRPIRFVK

SEQ ID NO: 1898 - protein, 123 aa, unidentified
  REGION 1..123: note = Description of Unknown: uncultivated organism with predicted taxonomy: Verrucomicrobia
  REGION 1..123: note = MG1-78 RuvC-III domain
AETAWISKLAQTIISLRFGWPGGIANGERKIIVVSGGLTGRIRRKYKLNSLLNPDAKSEEEAEVKNRNDDRHHALDAMVISFIPNWARDAKKTGFFRFPDGIHRELFAKEIADVIPLNVCFEK

SEQ ID NO: 1899 - protein, 156 aa, unidentified
  REGION 1..156: note = Description of Unknown: uncultivated organism
  REGION 1..156: note = MG1-79 RuvC-III domain
QLARHLRAEVIHWLGLDQIQDQKERNKEIARRIGTPTGFQTSVCRESWTPPHVFPQMYRLLCDKKGVPVRDRNGQERWVKDRTNLRHHLWDAAVLSHIPPGVGLNSADCGGIFVHRRDPQNGEWSVSALADLGPDLVAFEKANADRCLVVRLRQRK

SEQ ID NO: 1900 - protein, 123 aa, unidentified; identical to SEQ ID NO: 1898
  REGION 1..123: note = Description of Unknown: uncultivated organism with predicted taxonomy: Verrucomicrobia
  REGION 1..123: note = MG1-80 RuvC-III domain

SEQ ID NO: 1901 - protein, 169 aa, unidentified
  REGION 1..169: note = Description of Unknown: uncultivated organism
  REGION 1..169: note = MG1-81 RuvC-III domain
QHTAYIARIVRHVALIRLGWTGDDGRDPTIIKGNKPSSSFQVTNGQLTSRLRQAWGLNHILHPLPEGKRWDDLTDAEKEQMQQKNRGDLRHHALDAMVIACTLPWLAHRTVGATDPETGEHGWWQLDERTRRSLALNPVFPTEGQMRRVAEEWMQKVVVRHHVSRSPHQ

SEQ ID NO: 1902 - protein, 19 aa, unidentified
  REGION 1..19: note = Description of Unknown: uncultivated organism
  REGION 1..19: note = MG1-82 RuvC-III domain
AETAWISKLAQTIVNLRFG

SEQ ID NO: 1903 - protein, 156 aa, unidentified
  REGION 1..156: note = Description of Unknown: uncultivated organism
  REGION 1..156: note = MG1-83 RuvC-III domain
QIARYLRVEIIHWLGLDRIKNEMERNKQIAGRIGTPTGFQTSICRESWTPRTVFPQMYRLLHDKKGIPVRDQHGRERWVKDRTNLRHHLWDAAVLSHIPPREGLNSADCGGIFVHRRDQQTGEWRVSALPNLGPDLVAFEKENEGRCLVAHLRQRK

SEQ ID NO: 1904 - protein, 138 aa, unidentified
  REGION 1..138: note = Description of Unknown: uncultivated organism with predicted taxonomy: Coraliomargarita sp. CAG:312
  REGION 1..138: note = MG1-84 RuvC-III domain
AETAWISKLAQRIVCMHFGFQFGGNTGEKRVFTVPGNITAKIRSAFGLNKILHNIDADKKNMSEFDIVKLDYELDKKNRKNKKHHALDAMCLCFAPTGPNAQKLGIGALLPPEIAAKAEEFFRGYIEKVVPNEVAPKK

SEQ ID NO: 1905 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-85 RuvC-III domain

SEQ ID NO: 1906 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-86 RuvC-III domain

SEQ ID NO: 1907 - protein, 142 aa, unidentified
  REGION 1..142: note = Description of Unknown: uncultivated organism with predicted taxonomy: Verrucomicrobia
  REGION 1..142: note = MG1-87 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVKK

SEQ ID NO: 1908 - protein, 140 aa, unidentified
  REGION 1..140: note = Description of Unknown: uncultivated organism with predicted taxonomy: unclassified Verrucomicrobia (miscellaneous)
  REGION 1..140: note = MG1-88 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1909 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-89 RuvC-III domain

SEQ ID NO: 1910 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-90 RuvC-III domain

SEQ ID NO: 1911 - protein, 142 aa, unidentified
  REGION 1..142: note = Description of Unknown: uncultivated organism
  REGION 1..142: note = MG1-91 RuvC-III domain
AETAWISKLAQRICCIHFGFQFGGLTGEKKVWTVSGNTTAMIRSRYGLNRLLHNEDVPKDISLSERLKLESEFERKNRDNKKHHALDAMCLCYAPTSNTRRAASYKNILPAEITRNPESDEARRFFGGYLANVIPNKVAIEK

SEQ ID NO: 1912 - protein, 140 aa, unidentified
  REGION 1..140: note = Description of Unknown: uncultivated organism with predicted taxonomy: unclassified Verrucomicrobia (miscellaneous)
  REGION 1..140: note = MG1-92 RuvC-III domain
AETAHISKLAQKIVCLHFGFQFGGLSGTKRVFTVPGSLTARIRTFYGLNKILHNEDLAHETLSYEGFLKRGEELDKKNRANKKHHALDAMCLCFAPTGVNSKRARVDMLLPPKIRSEKDAELFFRKYLDKLIPVDVAPKK

SEQ ID NO: 1913 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-93 RuvC-III domain

SEQ ID NO: 1914 - protein, 142 aa, unidentified
  REGION 1..142: note = Description of Unknown: uncultivated organism with predicted taxonomy: unclassified Verrucomicrobia (miscellaneous)
  REGION 1..142: note = MG1-94 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARNFFAKYLEEVVPTKVAIKK

SEQ ID NO: 1915 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-95 RuvC-III domain

SEQ ID NO: 1916 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-96 RuvC-III domain

SEQ ID NO: 1917 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-97 RuvC-III domain

SEQ ID NO: 1918 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-98 RuvC-III domain

SEQ ID NO: 1919 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-99 RuvC-III domain

SEQ ID NO: 1920 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-100 RuvC-III domain

SEQ ID NO: 1921 - protein, 138 aa, unidentified
  REGION 1..138: note = Description of Unknown: uncultivated organism with predicted taxonomy: unclassified Verrucomicrobia (miscellaneous)
  REGION 1..138: note = MG1-101 RuvC-III domain
AETAWISKLAQQVVCLHFGFQFGGMEGQRRVFCIPGGVTARIRGMFGLNELLHVKDYDTDSMSETEIVELHKRLEKKNRENKKHHALDAMCLCFAPTGSQIKRFDAKTIMPEGILGREKQYFKSYLDKIVPNEVATQK

SEQ ID NO: 1922 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-102 RuvC-III domain

SEQ ID NO: 1923 - protein, 140 aa, unidentified
  REGION 1..140: note = Description of Unknown: uncultivated organism with predicted taxonomy: Verrucomicrobia
  REGION 1..140: note = MG1-103 RuvC-III domain
AETAHIAKLAQKIVCMHFGFQFGGLSGTKRVFTLPGALTSRIRKFYGLDRILHISAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 1924 - protein, 138 aa, unidentified; identical to SEQ ID NO: 1904
  REGION 1..138: note = Description of Unknown: uncultivated organism with predicted taxonomy: Verrucomicrobia
  REGION 1..138: note = MG1-104 RuvC-III domain

SEQ ID NO: 1925 - protein, 140 aa, unidentified
  REGION 1..140: note = Description of Unknown: uncultivated organism
  REGION 1..140: note = MG1-105 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRVKLGEILPEKLKSEKAAREFFKSYLDKIMPVDVAPKK

SEQ ID NO: 1926 - protein, 142 aa, unidentified
  REGION 1..142: note = Description of Unknown: uncultivated organism with predicted taxonomy: Verrucomicrobia
  REGION 1..142: note = MG1-106 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLATVIPNKVAVEK

SEQ ID NO: 1927 - protein, 142 aa, unidentified; identical to SEQ ID NO: 1907
  REGION 1..142: note = Description of Unknown: uncultivated organism with predicted taxonomy: Verrucomicrobia
  REGION 1..142: note = MG1-107 RuvC-III domain

SEQ ID NO: 1928 - protein, 142 aa, unidentified
  REGION 1..142: note = Description of Unknown: uncultivated organism with predicted taxonomy: Verrucomicrobia
  REGION 1..142: note = MG1-108 RuvC-III domain
AETAWISKLAQRICCLHFGFQFGGLAGAKKVWTVSGNTTAMIRGRYGLNRLLHDEEAAEDLSLFDRICMEKKFEEKNRKNKKHHALDAMCLCFAPTSNAKKASAYKNILPEEITRNPESDEARKFFGRYLATVIPNKVAVEK

SEQ ID NO: 1929 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-109 RuvC-III domain

SEQ ID NO: 1930 - protein, 142 aa, unidentified
  REGION 1..142: note = Description of Unknown: uncultivated organism with predicted taxonomy: Verrucomicrobia
  REGION 1..142: note = MG1-110 RuvC-III domain
AETAWISKLAQRICCLHFGFQFGGLAGAKKVWTVSGNTTAMIRGRYGLNRLLHDEESAEDLSLFDRICMEKKLEEKNRKNKKHHALDAMCLCFAPTSNAKKASAYKNILPEEITRNPESDEARKFFGKYLANVIPNKVAVEK

SEQ ID NO: 1931 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-111 RuvC-III domain

SEQ ID NO: 1932 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-112 RuvC-III domain

SEQ ID NO: 1933 - protein, 140 aa, unidentified
  REGION 1..140: note = Description of Unknown: uncultivated organism with predicted taxonomy: Verrucomicrobia
  REGION 1..140: note = MG1-113 RuvC-III domain
AETAHISKLAQKIVCLHFGFQFGGLGGTKRVFTVPGALTARIRSFYGLNKILHNEDLAKDALSYEEVLKRGEELDKKNRENEKHHALDAMCLCFAPTGVNSKRARIDMLLPPDIRGEGKAELFFRKYLDRLIPVDVAPKK

SEQ ID NO: 1934 - protein, 140 aa, unidentified; identical to SEQ ID NO: 1912
  REGION 1..140: note = Description of Unknown: uncultivated organism with predicted taxonomy: unclassified Verrucomicrobia (miscellaneous)
  REGION 1..140: note = MG1-114 RuvC-III domain

SEQ ID NO: 1935 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-115 RuvC-III domain

SEQ ID NO: 1936 - protein, 142 aa, unidentified
  REGION 1..142: note = Description of Unknown: uncultivated organism with predicted taxonomy: Verrucomicrobia
  REGION 1..142: note = MG1-116 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGRYLATVIPNKVAVEK

SEQ ID NO: 1937 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-117 RuvC-III domain

SEQ ID NO: 1938 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-118 RuvC-III domain

SEQ ID NO: 1939 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-119 RuvC-III domain

SEQ ID NO: 1940 - protein, 140 aa, unidentified
  REGION 1..140: note = Description of Unknown: uncultivated organism with predicted taxonomy: unclassified Verrucomicrobia (miscellaneous)
  REGION 1..140: note = MG1-120 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1941 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-121 RuvC-III domain

SEQ ID NO: 1942 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-122 RuvC-III domain

SEQ ID NO: 1943 - protein, 140 aa, unidentified
  REGION 1..140: note = Description of Unknown: uncultivated organism with predicted taxonomy: unclassified Verrucomicrobia (miscellaneous)
  REGION 1..140: note = MG1-123 RuvC-III domain
AETAHIAKLAQKIVCMHFGFQFGGLSGTKRVFTVPGALTSRIRKFYGLDRILHNSAAERENLSFEEFLKFSEDLEKKNRKNKKHHALDAMCLCFAPTGVDSRRAKLGEILPEKLRSEKAAREFFKSYLDKIMPVDVAPKK

SEQ ID NO: 1944 - protein, 142 aa, unidentified
  REGION 1..142: note = Description of Unknown: uncultivated organism with predicted taxonomy: Verrucomicrobia
  REGION 1..142: note = MG1-124 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLASVIPNKVAVEK

SEQ ID NO: 1945 - protein, 138 aa, unidentified; identical to SEQ ID NO: 1904
  REGION 1..138: note = Description of Unknown: uncultivated organism with predicted taxonomy: Verrucomicrobia
  REGION 1..138: note = MG1-125 RuvC-III domain

SEQ ID NO: 1946 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-126 RuvC-III domain

SEQ ID NO: 1947 - protein, 142 aa, unidentified; identical to SEQ ID NO: 1926
  REGION 1..142: note = Description of Unknown: uncultivated organism with predicted taxonomy: Verrucomicrobia
  REGION 1..142: note = MG1-127 RuvC-III domain

SEQ ID NO: 1948 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-128 RuvC-III domain

SEQ ID NO: 1949 - protein, 142 aa, unidentified
  REGION 1..142: note = Description of Unknown: uncultivated organism with predicted taxonomy: Verrucomicrobia
  REGION 1..142: note = MG1-129 RuvC-III domain
AETAWISKLAQRICCLHFGFQFGGLAGAKKVWTVSGNTTAMIRGRYALNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1950 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-130 RuvC-III domain

SEQ ID NO: 1951 - protein, 140 aa, unidentified; identical to SEQ ID NO: 1912
  REGION 1..140: note = Description of Unknown: uncultivated organism with predicted taxonomy: unclassified Verrucomicrobia (miscellaneous)
  REGION 1..140: note = MG1-131 RuvC-III domain

SEQ ID NO: 1952 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-132 RuvC-III domain

SEQ ID NO: 1953 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-133 RuvC-III domain

SEQ ID NO: 1954 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-134 RuvC-III domain

SEQ ID NO: 1955 - protein, 140 aa, unidentified
  REGION 1..140: note = Description of Unknown: uncultivated organism with predicted taxonomy: unclassified Verrucomicrobia (miscellaneous)
  REGION 1..140: note = MG1-135 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSGRAKLGEILPEKLRSEKAAREFFKSYLDKIMPVDVAPKK

SEQ ID NO: 1956 - protein, 142 aa, unidentified; identical to SEQ ID NO: 1907
  REGION 1..142: note = Description of Unknown: uncultivated organism with predicted taxonomy: Verrucomicrobia
  REGION 1..142: note = MG1-136 RuvC-III domain

SEQ ID NO: 1957 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-137 RuvC-III domain

SEQ ID NO: 1958 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-138 RuvC-III domain

SEQ ID NO: 1959 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-139 RuvC-III domain

SEQ ID NO: 1960 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-140 RuvC-III domain

SEQ ID NO: 1961 - protein, 142 aa, unidentified
  REGION 1..142: note = Description of Unknown: uncultivated organism with predicted taxonomy: Verrucomicrobia
  REGION 1..142: note = MG1-141 RuvC-III domain
AETAWISKLAQRICCLHFGFQFGGLAGAKKVWTVSGNTTSMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 1962 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-142 RuvC-III domain

SEQ ID NO: 1963 - protein, 140 aa, unidentified
  REGION 1..140: note = Description of Unknown: uncultivated organism with predicted taxonomy: Verrucomicrobia bacterium
  REGION 1..140: note = MG1-143 RuvC-III domain
AETAHISKLAQKIVCLHFGFQFGGLGGTKRVFTVPGALTARIRSFYGLNKILHNEDLAKDALSYEEVLKRGEELDKKNRKNKKHHALDAMCLCFAPTGVNSKRARIDMLLPPDIRGERKAELFFRKYLDRLIPVDVAPKK

SEQ ID NO: 1964 - protein, 140 aa, unidentified
  REGION 1..140: note = Description of Unknown: uncultivated organism with predicted taxonomy: unclassified Verrucomicrobia (miscellaneous)
  REGION 1..140: note = MG1-144 RuvC-III domain
AETAHISKLAQKIVCLHFGFQFGGLSGTKRVFTVPGSLTARIRTFYGLNKILHNEDLAHETLSYEGFLKRVEELDKKNRANKKHHALDAMCLCFAPTGVNSKRARVDMLLPPKIRSEKDAELFFRKYLDKLIPVDVAPKK

SEQ ID NO: 1965 - protein, 142 aa, unidentified; identical to SEQ ID NO: 1926
  REGION 1..142: note = Description of Unknown: uncultivated organism with predicted taxonomy: Verrucomicrobia
  REGION 1..142: note = MG1-145 RuvC-III domain

SEQ ID NO: 1966 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-147 RuvC-III domain

SEQ ID NO: 1967 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-148 RuvC-III domain

SEQ ID NO: 1968 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-149 RuvC-III domain

SEQ ID NO: 1969 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-150 RuvC-III domain

SEQ ID NO: 1970 - protein, 140 aa, unidentified
  REGION 1..140: note = Description of Unknown: uncultivated organism with predicted taxonomy: Verrucomicrobia
  REGION 1..140: note = MG1-151 RuvC-III domain
AETAHISKLAQKIVCLHFGFQFGGLGGTKRVFTVTGALTARIRSFYGLNKILHNEDLAKDALSYEEVLKRGEELDKKNRKNKKHHALDAMCLCFAPTGVNSKRARIDMLLPPDIRGEREAELFFRKYLDRLIPVDVAPKK

SEQ ID NO: 1971 - protein, 142 aa, unidentified; identical to SEQ ID NO: 1911
  REGION 1..142: note = Description of Unknown: uncultivated organism
  REGION 1..142: note = MG1-152 RuvC-III domain

SEQ ID NO: 1972 - protein, 140 aa, unidentified
  REGION 1..140: note = Description of Unknown: uncultivated organism with predicted taxonomy: unclassified Verrucomicrobia (miscellaneous)
  REGION 1..140: note = MG1-153 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPMDVAPKK

SEQ ID NO: 1973 - protein, 142 aa, unidentified; identical to SEQ ID NO: 1949
  REGION 1..142: note = Description of Unknown: uncultivated organism with predicted taxonomy: Verrucomicrobia
  REGION 1..142: note = MG1-154 RuvC-III domain

SEQ ID NO: 1974 - protein, 142 aa, unidentified
  REGION 1..142: note = Description of Unknown: uncultivated organism with predicted taxonomy: Verrucomicrobia
  REGION 1..142: note = MG1-155 RuvC-III domain
AETAWISKLAQRVCCIHFGFQFGGLTGVKKVWTVSGNTTAMIRSRYGLNRLLHDENVPKDISLSERLKLENDFEKKNRDNKKHHALDAMCLCYAPTSNTRRAASYKNILPAEITRNPESDEARRFFGRYLANVIPNKVAIEK

SEQ ID NO: 1975 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-156 RuvC-III domain

SEQ ID NO: 1976 - protein, 138 aa, unidentified
  REGION 1..138: note = Description of Unknown: uncultivated organism with predicted taxonomy: Verrucomicrobia
  REGION 1..138: note = MG1-157 RuvC-III domain
AETAWISKLAQQVVCLHFGFQFGGMEGQRRVFCIPGGVTARIRGMFGLNELLHVKDYDTDSMSETEIVELYKRLEKKNRENKKHHALDAMCLCFAPTGSQIKRFDAKTIMPEGILGREKQYFKSYLDKIVPNEVATQK

SEQ ID NO: 1977 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-158 RuvC-III domain

SEQ ID NO: 1978 - protein, 136 aa, unidentified
  REGION 1..136: note = Description of Unknown: uncultivated organism with predicted taxonomy: Coraliomargarita sp. CAG:312
  REGION 1..136: note = MG1-159 RuvC-III domain
AETAWIARLAQRIVCMHFGFPMGALIGKKRVFTVSGSVTSRIRGMYGLNKILHNTEIDKTLSEVDILKLNDSLETKNRANKKHHALDAMCLCFAPTSKEVLNKNREILPVEIAKDAENYFRRYLDNIIPNKVATMK

SEQ ID NO: 1979 - protein, 140 aa, unidentified; identical to SEQ ID NO: 1925
  REGION 1..140: note = Description of Unknown: uncultivated organism with predicted taxonomy: unclassified Verrucomicrobia (miscellaneous)
  REGION 1..140: note = MG1-160 RuvC-III domain

SEQ ID NO: 1980 - protein, 142 aa, unidentified; identical to SEQ ID NO: 1911
  REGION 1..142: note = Description of Unknown: uncultivated organism with predicted taxonomy: Verrucomicrobia
  REGION 1..142: note = MG1-161 RuvC-III domain

SEQ ID NO: 1981 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-162 RuvC-III domain

SEQ ID NO: 1982 - protein, 140 aa, unidentified
  REGION 1..140: note = Description of Unknown: uncultivated organism with predicted taxonomy: unclassified Verrucomicrobia (miscellaneous)
  REGION 1..140: note = MG1-163 RuvC-III domain
AETAHISKLAQKIVCLHFGFQFGGLSGTKRVFTVPGSLTARIRTFYGLNKILHNEDLAHETLSFEGFLKRGEELDKKNRANKKHHALDAMCLCFAPTGVNSKRARVDMLLPPKIRSEKDAELFFRKYLDKLIPVDVAPKK

SEQ ID NO: 1983 - protein, 142 aa, unidentified
  REGION 1..142: note = Description of Unknown: uncultivated organism with predicted taxonomy: Verrucomicrobia
  REGION 1..142: note = MG1-164 RuvC-III domain
AETAWISKLAQKICCIHFGFQFGGLKGEKKVWTVSGNTTAMIRGRYGLNRLLHNEEISEDLPLLDRIVKEKNFEEKNRDNKKHHALDAMCICFAPTSNAKKALSRKNILPEEIAKNPESDDARKFFAKYLAEVVPTKVAIKK

SEQ ID NO: 1984 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-165 RuvC-III domain

SEQ ID NO: 1985 - protein, 140 aa, unidentified
  REGION 1..140: note = Description of Unknown: uncultivated organism with predicted taxonomy: unclassified Verrucomicrobia (miscellaneous)
  REGION 1..140: note = MG1-166 RuvC-III domain
AETAHIAKLAQKIVCMHFGFQFGGLSGTKRVFTVPGALTSRIRKFYGLDRILHNSASESENLSFEEFLKFSEDLEKKNRKNKKHHALDAMCLCFAPTGVDSRRAKLGEILPEKLRSEKAAREFFKSYLEKIMPVDVAPKK

SEQ ID NO: 1986 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-167 RuvC-III domain

SEQ ID NO: 1987 - protein, 142 aa, unidentified; identical to SEQ ID NO: 1911
  REGION 1..142: note = Description of Unknown: uncultivated organism with predicted taxonomy: Verrucomicrobia
  REGION 1..142: note = MG1-168 RuvC-III domain

SEQ ID NO: 1988 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-169 RuvC-III domain

SEQ ID NO: 1989 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-170 RuvC-III domain

SEQ ID NO: 1990 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-171 RuvC-III domain

SEQ ID NO: 1991 - protein, 142 aa, unidentified; identical to SEQ ID NO: 1907
  REGION 1..142: note = Description of Unknown: uncultivated organism with predicted taxonomy: Verrucomicrobia
  REGION 1..142: note = MG1-172 RuvC-III domain

SEQ ID NO: 1992 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-173 RuvC-III domain

SEQ ID NO: 1993 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-174 RuvC-III domain

SEQ ID NO: 1994 - protein, 142 aa, unidentified; identical to SEQ ID NO: 1944
  REGION 1..142: note = Description of Unknown: uncultivated organism with predicted taxonomy: Coraliomargarita sp. CAG:312
  REGION 1..142: note = MG1-175 RuvC-III domain

SEQ ID NO: 1995 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-176 RuvC-III domain

SEQ ID NO: 1996 - protein, 142 aa, unidentified; identical to SEQ ID NO: 1926
  REGION 1..142: note = Description of Unknown: uncultivated organism with predicted taxonomy: Verrucomicrobia
  REGION 1..142: note = MG1-177 RuvC-III domain

SEQ ID NO: 1997 - protein, 136 aa, unidentified; identical to SEQ ID NO: 1978
  REGION 1..136: note = Description of Unknown: uncultivated organism with predicted taxonomy: Coraliomargarita sp. CAG:312
  REGION 1..136: note = MG1-178 RuvC-III domain

SEQ ID NO: 1998 - protein, 142 aa, unidentified; identical to SEQ ID NO: 1961
  REGION 1..142: note = Description of Unknown: uncultivated organism with predicted taxonomy: Coraliomargarita sp. CAG:312
  REGION 1..142: note = MG1-179 RuvC-III domain

SEQ ID NO: 1999 - protein, 140 aa, unidentified
  REGION 1..140: note = Description of Unknown: uncultivated organism with predicted taxonomy: unclassified Verrucomicrobia (miscellaneous)
  REGION 1..140: note = MG1-180 RuvC-III domain
AETAHIAKLAQKIVCMHFGFQFGGVSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2000 - protein, 140 aa, unidentified; identical to SEQ ID NO: 1912
  REGION 1..140: note = Description of Unknown: uncultivated organism with predicted taxonomy: unclassified Verrucomicrobia (miscellaneous)
  REGION 1..140: note = MG1-181 RuvC-III domain

SEQ ID NO: 2001 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-182 RuvC-III domain

SEQ ID NO: 2002 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-183 RuvC-III domain

SEQ ID NO: 2003 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-184 RuvC-III domain

SEQ ID NO: 2004 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-185 RuvC-III domain

SEQ ID NO: 2005 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-186 RuvC-III domain

SEQ ID NO: 2006 - protein, 142 aa, unidentified
  REGION 1..142: note = Description of Unknown: uncultivated organism with predicted taxonomy: Verrucomicrobia
  REGION 1..142: note = MG1-187 RuvC-III domain
AETAWISKLAQRICCLHFGFQFGGLAGAKKVWTVSGNTTAMIRGRYGLNRLLHDEESAEDLSLFDRICMEKKFEEKNRKNKKHHALDAMCLCFAPTSNAKKASAYKNILPEEITRNPESDEARKFFGKYLANVIPNKVAVEK

SEQ ID NO: 2007 - protein, 138 aa, unidentified; identical to SEQ ID NO: 1904
  REGION 1..138: note = Description of Unknown: uncultivated organism with predicted taxonomy: Verrucomicrobia
  REGION 1..138: note = MG1-188 RuvC-III domain

SEQ ID NO: 2008 - protein, 142 aa, unidentified; identical to SEQ ID NO: 1936
  REGION 1..142: note = Description of Unknown: uncultivated organism with predicted taxonomy: Verrucomicrobia
  REGION 1..142: note = MG1-189 RuvC-III domain

SEQ ID NO: 2009 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-190 RuvC-III domain

SEQ ID NO: 2010 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-191 RuvC-III domain

SEQ ID NO: 2011 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-192 RuvC-III domain

SEQ ID NO: 2012 - protein, 142 aa, unidentified; identical to SEQ ID NO: 1949
  REGION 1..142: note = Description of Unknown: uncultivated organism with predicted taxonomy: Verrucomicrobia
  REGION 1..142: note = MG1-193 RuvC-III domain

SEQ ID NO: 2013 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-194 RuvC-III domain

SEQ ID NO: 2014 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-195 RuvC-III domain

SEQ ID NO: 2015 - protein, 140 aa, unidentified; identical to SEQ ID NO: 1940
  REGION 1..140: note = Description of Unknown: uncultivated organism with predicted taxonomy: Verrucomicrobia
  REGION 1..140: note = MG1-196 RuvC-III domain

SEQ ID NO: 2016 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-197 RuvC-III domain

SEQ ID NO: 2017 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-198 RuvC-III domain

SEQ ID NO: 2018 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-199 RuvC-III domain

SEQ ID NO: 2019 - protein, 142 aa, unidentified; identical to SEQ ID NO: 1949
  REGION 1..142: note = Description of Unknown: uncultivated organism
  REGION 1..142: note = MG1-200 RuvC-III domain

SEQ ID NO: 2020 - protein, 142 aa, unidentified; identical to SEQ ID NO: 1944
  REGION 1..142: note = Description of Unknown: uncultivated organism with predicted taxonomy: Verrucomicrobia
  REGION 1..142: note = MG1-201 RuvC-III domain

SEQ ID NO: 2021 - protein, 142 aa, unidentified; identical to SEQ ID NO: 2006
  REGION 1..142: note = Description of Unknown: uncultivated organism with predicted taxonomy: Coraliomargarita sp. CAG:312
  REGION 1..142: note = MG1-202 RuvC-III domain

SEQ ID NO: 2022 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-203 RuvC-III domain

SEQ ID NO: 2023 - protein, 142 aa, unidentified; identical to SEQ ID NO: 1930
  REGION 1..142: note = Description of Unknown: uncultivated organism with predicted taxonomy: Verrucomicrobia
  REGION 1..142: note = MG1-204 RuvC-III domain

SEQ ID NO: 2024 - protein, 142 aa, unidentified; identical to SEQ ID NO: 1944
  REGION 1..142: note = Description of Unknown: uncultivated organism with predicted taxonomy: Coraliomargarita sp. CAG:312
  REGION 1..142: note = MG1-205 RuvC-III domain

SEQ ID NO: 2025 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-206 RuvC-III domain

SEQ ID NO: 2026 - protein, 140 aa, unidentified; identical to SEQ ID NO: 1940
  REGION 1..140: note = Description of Unknown: uncultivated organism with predicted taxonomy: unclassified Verrucomicrobia (miscellaneous)
  REGION 1..140: note = MG1-207 RuvC-III domain

SEQ ID NO: 2027 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-208 RuvC-III domain

SEQ ID NO: 2028 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-209 RuvC-III domain

SEQ ID NO: 2029 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-210 RuvC-III domain

SEQ ID NO: 2030 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-211 RuvC-III domain

SEQ ID NO: 2031 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-212 RuvC-III domain

SEQ ID NO: 2032 - protein, 115 aa, unidentified
  REGION 1..115: note = Description of Unknown: uncultivated organism with predicted taxonomy: unclassified Verrucomicrobia (miscellaneous)
  REGION 1..115: note = MG1-213 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRRAKLGEILPEKLR

SEQ ID NO: 2033 - protein, 140 aa, unidentified
  REGION 1..140: note = Description of Unknown: uncultivated organism with predicted taxonomy: unclassified Verrucomicrobia (miscellaneous)
  REGION 1..140: note = MG1-214 RuvC-III domain
AETAHIAKLAQKIVCMHFGFQFGGLSGTKRVFTVPGALTSRIRKFYGLDRILHNSAAESENLSFEEFLKFSEDLEKKNRKNKKHHALDAMCLCFAPTGVDSRCAKLGEILPEKLRSEKAAREFFKSYLDKIMPVDVAPKK

SEQ ID NO: 2034 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-215 RuvC-III domain

SEQ ID NO: 2035 - protein, 140 aa, unidentified
  REGION 1..140: note = Description of Unknown: uncultivated organism with predicted taxonomy: unclassified Verrucomicrobia (miscellaneous)
  REGION 1..140: note = MG1-216 RuvC-III domain
AETAHIAKLAQKIVCMHFGFQFGGLSGAKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2036 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-217 RuvC-III domain

SEQ ID NO: 2037 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-218 RuvC-III domain

SEQ ID NO: 2038 - protein, 140 aa, unidentified; identical to SEQ ID NO: 1925
  REGION 1..140: note = Description of Unknown: uncultivated organism with predicted taxonomy: unclassified Verrucomicrobia (miscellaneous)
  REGION 1..140: note = MG1-219 RuvC-III domain

SEQ ID NO: 2039 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-220 RuvC-III domain

SEQ ID NO: 2040 - protein, 66 aa, unidentified
  REGION 1..66: note = Description of Unknown: uncultivated organism with predicted taxonomy: unclassified Verrucomicrobia (miscellaneous)
  REGION 1..66: note = MG1-221 RuvC-III domain
AETAHIAKLAQKIVCMHFGFQFGGLSGTKRVFAVPGALTSRIRKFYGLDRILHNSEAESENLSFEE

SEQ ID NO: 2041 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-222 RuvC-III domain

SEQ ID NO: 2042 - protein, 140 aa, unidentified
  REGION 1..140: note = Description of Unknown: uncultivated organism with predicted taxonomy: unclassified Verrucomicrobia (miscellaneous)
  REGION 1..140: note = MG1-223 RuvC-III domain
AETAHIAKLAQKIVCMHFGFQFGRLSGTKRVFTVPGALTSRIRKFYGLDRILHNSAAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2043 - protein, 140 aa, unidentified; identical to SEQ ID NO: 1964
  REGION 1..140: note = Description of Unknown: uncultivated organism with predicted taxonomy: unclassified Verrucomicrobia (miscellaneous)
  REGION 1..140: note = MG1-224 RuvC-III domain

SEQ ID NO: 2044 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-225 RuvC-III domain

SEQ ID NO: 2045 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-226 RuvC-III domain

SEQ ID NO: 2046 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-227 RuvC-III domain

SEQ ID NO: 2047 - protein, 140 aa, unidentified
  REGION 1..140: note = Description of Unknown: uncultivated organism with predicted taxonomy: unclassified Verrucomicrobia (miscellaneous)
  REGION 1..140: note = MG1-228 RuvC-III domain
AETAHIAKLAQKIVCMHFGFQFGGLSGTKRVFTVPGALTSRIRKFYGLDRILHNSEAESENLSFEEFLKFSEDLEKKNRKNKKHHALDAMCLCFAPTGVDSRRAKLGEILPEKLRSEKAAREFFKSYLDKIMPVDVAPKK

SEQ ID NO: 2048 - protein, 140 aa, unidentified; identical to SEQ ID NO: 1881
  REGION 1..140: note = Description of Unknown: uncultivated organism with predicted taxonomy: Verrucomicrobia
  REGION 1..140: note = MG1-229 RuvC-III domain

SEQ ID NO: 2049 - protein, 140 aa, unidentified; identical to SEQ ID NO: 1881
  REGION 1..140: note = Description of Unknown: uncultivated organism with predicted taxonomy: Verrucomicrobia
  REGION 1..140: note = MG1-230 RuvC-III domain

SEQ ID NO: 2050 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-231 RuvC-III domain

SEQ ID NO: 2051 - protein, 142 aa, unidentified; identical to SEQ ID NO: 1949
  REGION 1..142: note = Description of Unknown: uncultivated organism with predicted taxonomy: Verrucomicrobia
  REGION 1..142: note = MG1-232 RuvC-III domain

SEQ ID NO: 2052 - protein, 140 aa, unidentified; identical to SEQ ID NO: 1933
  REGION 1..140: note = Description of Unknown: uncultivated organism
  REGION 1..140: note = MG1-233 RuvC-III domain

SEQ ID NO: 2053 - protein, 140 aa, unidentified; identical to SEQ ID NO: 1955
  REGION 1..140: note = Description of Unknown: uncultivated organism with predicted taxonomy: unclassified Verrucomicrobia (miscellaneous)
  REGION 1..140: note = MG1-234 RuvC-III domain

SEQ ID NO: 2054 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-236 RuvC-III domain

SEQ ID NO: 2055 - protein, 140 aa, unidentified; identical to SEQ ID NO: 1908
  REGION 1..140: note = Description of Unknown: uncultivated organism with predicted taxonomy: Verrucomicrobia
  REGION 1..140: note = MG1-237 RuvC-III domain

SEQ ID NO: 2056 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-238 RuvC-III domain

SEQ ID NO: 2057 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-239 RuvC-III domain

SEQ ID NO: 2058 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-240 RuvC-III domain

SEQ ID NO: 2059 - protein, 138 aa, unidentified; identical to SEQ ID NO: 1904
  REGION 1..138: note = Description of Unknown: uncultivated organism with predicted taxonomy: Verrucomicrobia
  REGION 1..138: note = MG1-241 RuvC-III domain

SEQ ID NO: 2060 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-242 RuvC-III domain

SEQ ID NO: 2061 - protein, 142 aa, unidentified; identical to SEQ ID NO: 1974
  REGION 1..142: note = Description of Unknown: uncultivated organism with predicted taxonomy: Verrucomicrobia
  REGION 1..142: note = MG1-243 RuvC-III domain

SEQ ID NO: 2062 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-244 RuvC-III domain

SEQ ID NO: 2063 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-245 RuvC-III domain

SEQ ID NO: 2064 - protein, 140 aa, unidentified; identical to SEQ ID NO: 1940
  REGION 1..140: note = Description of Unknown: uncultivated organism with predicted taxonomy: unclassified Verrucomicrobia (miscellaneous)
  REGION 1..140: note = MG1-246 RuvC-III domain

SEQ ID NO: 2065 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-247 RuvC-III domain

SEQ ID NO: 2066 - protein, 140 aa, unidentified; identical to SEQ ID NO: 1970
  REGION 1..140: note = Description of Unknown: uncultivated organism with predicted taxonomy: unclassified Verrucomicrobia (miscellaneous)
  REGION 1..140: note = MG1-248 RuvC-III domain

SEQ ID NO: 2067 - protein, 140 aa, unidentified; identical to SEQ ID NO: 1972
  REGION 1..140: note = Description of Unknown: uncultivated organism with predicted taxonomy: unclassified Verrucomicrobia (miscellaneous)
  REGION 1..140: note = MG1-249 RuvC-III domain

SEQ ID NO: 2068 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-250 RuvC-III domain

SEQ ID NO: 2069 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-251 RuvC-III domain

SEQ ID NO: 2070 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-252 RuvC-III domain

SEQ ID NO: 2071 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-253 RuvC-III domain

SEQ ID NO: 2072 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-254 RuvC-III domain

SEQ ID NO: 2073 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-255 RuvC-III domain

SEQ ID NO: 2074 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-256 RuvC-III domain

SEQ ID NO: 2075 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-257 RuvC-III domain

SEQ ID NO: 2076 - protein, 142 aa, unidentified; identical to SEQ ID NO: 1911
  REGION 1..142: note = Description of Unknown: uncultivated organism with predicted taxonomy: Verrucomicrobia
  REGION 1..142: note = MG1-258 RuvC-III domain

SEQ ID NO: 2077 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-259 RuvC-III domain

SEQ ID NO: 2078 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-260 RuvC-III domain

SEQ ID NO: 2079 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-261 RuvC-III domain

SEQ ID NO: 2080 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-262 RuvC-III domain

SEQ ID NO: 2081 - protein, 138 aa, unidentified; identical to SEQ ID NO: 1976
  REGION 1..138: note = Description of Unknown: uncultivated organism with predicted taxonomy: Verrucomicrobia
  REGION 1..138: note = MG1-263 RuvC-III domain

SEQ ID NO: 2082 - protein, 140 aa, unidentified; identical to SEQ ID NO: 1830
  REGION 1..140: note = Description of Unknown: uncultivated organism with predicted taxonomy: unclassified Verrucomicrobia (miscellaneous)
  REGION 1..140: note = MG1-264 RuvC-III domain

SEQ ID NO: 2083 - protein, 140 aa, unidentified; identical to SEQ ID NO: 1982
  REGION 1..140: note = Description of Unknown: uncultivated organism with predicted taxonomy: unclassified Verrucomicrobia (miscellaneous)
  REGION 1..140: note = MG1-265 RuvC-III domain

SEQ ID NO: 2084 - protein, 138 aa, unidentified; identical to SEQ ID NO: 1904
  REGION 1..138: note = Description of Unknown: uncultivated organism with predicted taxonomy: Coraliomargarita sp. CAG:312
  REGION 1..138: note = MG1-266 RuvC-III domain

SEQ ID NO: 2085 - protein, 142 aa, unidentified; identical to SEQ ID NO: 1928
  REGION 1..142: note = Description of Unknown: uncultivated organism with predicted taxonomy: Verrucomicrobia
  REGION 1..142: note = MG1-267 RuvC-III domain

SEQ ID NO: 2086 - protein, 140 aa, unidentified; identical to SEQ ID NO: 1923
  REGION 1..140: note = Description of Unknown: uncultivated organism with predicted taxonomy: Verrucomicrobia
  REGION 1..140: note = MG1-268 RuvC-III domain

SEQ ID NO: 2087 - protein, 140 aa, unidentified; identical to SEQ ID NO: 1881
  REGION 1..140: note = Description of Unknown: uncultivated organism with predicted taxonomy: unclassified Verrucomicrobia (miscellaneous)
  REGION 1..140: note = MG1-269 RuvC-III domain

SEQ ID NO: 2088 - protein, 138 aa, unidentified; identical to SEQ ID NO: 1921
  REGION 1..138: note = Description of Unknown: uncultivated organism with predicted taxonomy: Verrucomicrobia
  REGION 1..138: note = MG1-270 RuvC-III domain

SEQ ID NO: 2089 - protein, 140 aa, unidentified; identical to SEQ ID NO: 1908
  REGION 1..140: note = Description of Unknown: uncultivated organism with predicted taxonomy: unclassified Verrucomicrobia (miscellaneous)
  REGION 1..140: note = MG1-271 RuvC-III domain

SEQ ID NO: 2090 - protein, 203 aa, unidentified
  REGION 1..203: note = Description of Unknown: uncultivated organism
  REGION 1..203: note = MG1-272 RuvC-III domain
QRTAYIARCLRYVCLLKFGWLSPEDRDPGHEKANDATRSYLVTNGGTTRRLRQAWNLDELLRETVSPEKWAGMTDVEKERALAQGARIPTEEWKKLDKAKQDDVLRARRTKNRQDVRHHALDAMVVACTLPWAANLTVWASGWCNLDTDDGSVSSVRCPIFGENDFGEGIYAAIEAKLSELKTALPEATSNAITHYRSHERHK

SEQ ID NO: 2091 - protein, 198 aa, unidentified
  REGION 1..198: note = Description of Unknown: uncultivated organism with predicted taxonomy: Rhizobiales
  REGION 1..198: note = MG1-273 RuvC-III domain
QQTAYIARCLREACLIIFGKEWLDWTDGAGRDPRLLTDNRASKNYLTTNGVITSRLRGAWHLNEVLWPKPERLNDTEWDKLTDDEKIPLKAKYKEERELRALKNRQDHRHHAIDAMVISCAMPWQTCKTRTGSQQSDDGLCEVDSETGAITKIWNPVFNDYGYGIKQAAEAKSALLLKFSSERQVDLLRHHKSNNRNA

SEQ ID NO: 2092 - protein, 198 aa, unidentified
  REGION 1..198: note = Description of Unknown: uncultivated organism
  REGION 1..198: note = MG1-274 RuvC-III domain
QQTAYIARCLREACLIHFGKEWLDWTDGAGRDPRLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2093 - protein, 125 aa, unidentified; identical to SEQ ID NO: 1839
  REGION 1..125: note = Description of Unknown: uncultivated organism
  REGION 1..125: note = MG1-275 RuvC-III domain

SEQ ID NO: 2094 - protein, 123 aa, unidentified
  REGION 1..123: note = Description of Unknown: uncultivated organism with predicted taxonomy: Verrucomicrobia bacterium IMCC26134
  REGION 1..123: note = MG1-276 RuvC-III domain
AETAWISKLAQTIVGLRFGWPGGIVDGKRKVIVVSGGLTGRIRRKYKLNRLLNPNASSEEEAETKNRDDDRHHALDAMVISFIPNWTRNAKLAGFFRFPEGVHGEFFANEIADVVPKNVALEK

SEQ ID NO: 2095 - protein, 174 aa, unidentified
  REGION 1..174: note = Description of Unknown: uncultivated organism
  REGION 1..174: note = MG1-277 RuvC-III domain
QHTAYIARVIRQTSLIQLGWLGEDGRDPTGLKDPQKTAWKFQVTNGHLTSRLRKAWGLNQILHPFPSKDEWGAMTPDEQENKKSELQEKNRGDLRHHALDAIVIACTMPWLAHRTVRVKDPETGEDGWWDLDERTQRSVARNPICPNEGQMYGLAKEEIEKVVVRHHVAKGNKR

SEQ ID NO: 2096 - protein, 166 aa, unidentified
  REGION 1..166: note = Description of Unknown: uncultivated organism
  REGION 1..166: note = MG1-279 RuvC-III domain
QHTAYIARVIRHISLIQLGWLNDAGRDPTPEKQNPALSFQVTNGQLTSRLRKSWGLNQILHPLPPGKRWDELTDEEQTQFTEKNRGDLRHHSLDAMVIACTLPWLAHRTHGATDQFGHHGWWTQDEKQRSKAANPLFPNEGQMHDVVKKEIEKVIVRHHVSRSNHK

SEQ ID NO: 2097 - protein, 203 aa, unidentified; identical to SEQ ID NO: 2090
  REGION 1..203: note = Description of Unknown: uncultivated organism
  REGION 1..203: note = MG1-280 RuvC-III domain

SEQ ID NO: 2098 - protein, 174 aa, unidentified; identical to SEQ ID NO: 2095
  REGION 1..174: note = Description of Unknown: uncultivated organism with predicted taxonomy: Thermoflexibacter ruber
  REGION 1..174: note = MG1-281 RuvC-III domain

SEQ ID NO: 2099 - protein, 174 aa, unidentified; identical to SEQ ID NO: 2095
  REGION 1..174: note = Description of Unknown: uncultivated organism
  REGION 1..174: note = MG1-282 RuvC-III domain

SEQ ID NO: 2100 - protein, 137 aa, unidentified
  REGION 1..137: note = Description of Unknown: uncultivated organism with predicted taxonomy: Verrucomicrobia bacterium IMCC26134
  REGION 1..137: note = MG1-283 RuvC-III domain
AETAWVSKLAQTIANLRFNWTNGYDQNRKKRVIVISGGVTARVRRKYGLDKLLYNKDTDAEVFAKKLKNRADKRHHALDAMVLTFVPQWARDPGKEGFFRFPAEFRDANGREDYEQIRKLFGDSIAKVMPRYLTYER

SEQ ID NO: 2101 - protein, 172 aa, unidentified
  REGION 1..172: note = Description of Unknown: uncultivated organism
  REGION 1..172: note = MG1-284 RuvC-III domain
QHTAYIARVIRQVSLIQLGWLAEDGRDATGLKDPEMTAWRFQVTNGSLTSRLRKSWGLNQILNPFPSKDAWEAMTPEEQEKKKTEMQEKNRGDLRHHSLDAMVIACTLPWLAHRTHGAKDSFGRPGWWWLDEKKRSQASTPIFPKEGQMHEVVKKEIEKVLVRHHVSRSNHQ

SEQ ID NO: 2102 - protein, 127 aa, unidentified
  REGION 1..127: note = Description of Unknown: uncultivated organism with predicted taxonomy: Verrucomicrobia
  REGION 1..127: note = MG1-285 RuvC-III domain
AETAWIAKLAQAIVGLHFGWRNGVDESGNKRVTVISGGLTGRIRRKYALNQILNPNAKTEEEAEKKNRDDDRHHALDAMVISFIPSWVRDAMKEKFFRFPEPIHQNAKGFFEKEIQSVKPRNIALQK

SEQ ID NO: 2103 - protein, 137 aa, unidentified; identical to SEQ ID NO: 1831
  REGION 1..137: note = Description of Unknown: uncultivated organism with predicted taxonomy: Verrucomicrobia
  REGION 1..137: note = MG1-287 RuvC-III domain

SEQ ID NO: 2104 - protein, 137 aa, unidentified; identical to SEQ ID NO: 1831
  REGION 1..137: note = Description of Unknown: uncultivated organism
  REGION 1..137: note = MG1-288 RuvC-III domain

SEQ ID NO: 2105 - protein, 146 aa, unidentified
  REGION 1..146: note = Description of Unknown: uncultivated organism with predicted taxonomy: Deltaproteobacteria bacterium RIFOXYA12_FULL_61_11
  REGION 1..146: note = MG1-290 RuvC-III domain
TQTAYIARALRGLCLLRQNWLTPEGRDPSDQPGGPGQFFQLTNGYLTAGIRRCWGLDELLPSALDDEGGKNRHDLRHHALDAAVIACTLPWAAHQPLSRGGWREAPPFGSARREQWRTPFDHLRSQIRARVPDIVPTQKVGTSAKQ

SEQ ID NO: 2106 - protein, 126 aa, unidentified
  REGION 1..126: note = Description of Unknown: uncultivated organism with predicted taxonomy: Candidatus Termititenax aidoneus
  REGION 1..126: note = MG1-291 RuvC-III domain
AETAYITKLTQKIAHLFFGWDWQTKGSHRKIIVQSGGYTSKIRKIFKLNALLYPEKTGDEIREIVETGKNRDNKRHHALDALVLSITPEIKYDEKKDADVYPVWFNPEYCKNALDKVNPTYIDFEK

SEQ ID NO: 2107 - protein, 133 aa, unidentified
  REGION 1..133: note = Description of Unknown: uncultivated organism with predicted taxonomy: Candidatus Termititenax aidoneus
  REGION 1..133: note = MG1-292 RuvC-III domain
SQTAYISKLAQKVTALTFGWGMQTKDDNRNIVIATGGQTARIRSRFKLDRLLHSGMTDEEFEKALRNGEIEKKNRSNPRHHALDALVLSAVPEIRVDKNRKGKYDDIYPSWLTRDFCEKEVAHVYPKQIKFSK

SEQ ID NO: 2108 - protein, 133 aa, unidentified; identical to SEQ ID NO: 2107
  REGION 1..133: note = Description of Unknown: uncultivated organism with predicted taxonomy: Elusimicrobia bacterium HGW-Elusimicrobia-1
  REGION 1..133: note = MG1-293 RuvC-III domain

SEQ ID NO: 2109 - protein, 129 aa, unidentified
  REGION 1..129: note = Description of Unknown: uncultivated organism with predicted taxonomy: Endomicrobium proavitum
  REGION 1..129: note = MG1-294 RuvC-III domain
QATSQIEKEAQTIASLLFGWGINTKGDKKKILFFTGGNTADVRKNLNLNRLLHPALSDEEYNELKKKKDFKDKNRKNTKHHALDALVLSVLPEITMDKKSIENKPEFFNIKFCEEQLKKVYPIIIKQTK

SEQ ID NO: 2110 - protein, 124 aa, unidentified
  REGION 1..124: note = Description of Unknown: uncultivated organism with predicted taxonomy: Verrucomicrobia bacterium 12-59-8
  REGION 1..124: note = MG1-295 RuvC-III domain
AETAYIARVARDVAALRCGWQPGEAGEKRHIHIINGANTAKVRGLYHLNSLLASDQGGLEPDKFMKKVRENKKHHALDAMVLSFIREWIRNPKTRQYEFPAGIDREYFRKCLENVVPYNCILPK

SEQ ID NO: 2111 - protein, 129 aa, unidentified
  REGION 1..129: note = Description of Unknown: uncultivated organism
  REGION 1..129: note = MG1-296 RuvC-III domain
QATMYIEKYAQKITALFFGWGEQTKGDERHIFVCNGGLTAKLRKENGLDRLLWSEEEFYKLMASGKLDEKNRENKKHHALDALVISFADDLRTDPKTGRKLFPEFAQNNPAFFSEAMDKVFPKQLRKKA

SEQ ID NO: 2112 - protein, 124 aa, unidentified; identical to SEQ ID NO: 2110
  REGION 1..124: note = Description of Unknown: uncultivated organism with predicted taxonomy: Verrucomicrobia bacterium 12-59-8
  REGION 1..124: note = MG1-297 RuvC-III domain

SEQ ID NO: 2113 - protein, 130 aa, unidentified
  REGION 1..130: note = Description of Unknown: uncultivated organism
  REGION 1..130: note = MG1-298 RuvC-III domain
QATRYIEKLAQKLISLYFGWGEQTTGDKRKMFVCTGGLTAKIRSQYGLNRLLHKDLSGEEFKKIVAEGKLDEKNRNNKRHHALDALVISFTRDIKYDNKGKPVLPDYACNPAFFADAIEKVFPVTIRSKK

SEQ ID NO: 2114 - protein, 127 aa, unidentified
  REGION 1..127: note = Description of Unknown: uncultivated organism
  REGION 1..127: note = MG1-299 RuvC-III domain
AETAWISRLAQKIADLSFGWKNGIDAAGRKRTVVVSGGLTARIRRKYGLNRILNPGASSEEEAEKKNRSDKRHHALDAMTISFIPQWARDPGKTGFFRFPKAIRDNPLPFFQARIDAVVPRQLCYEK

SEQ ID NO: 2115 - protein, 127 aa, unidentified
  REGION 1..127: note = Description of Unknown: uncultivated organism
  REGION 1..127: note = MG1-300 RuvC-III domain
AETAWISRLSQKIIDLTFGWSNGVDASGRKRSIIVSGGLTARIRRKYHLNHILNPDAETDEEAEKKNRKDKRHHALDAMTISFIPQWARDPDKTGFFRLPKEIRDNPLPFFAKRIDTVIPRQLCFEK

SEQ ID NO: 2116 - protein, 127 aa, unidentified
  REGION 1..127: note = Description of Unknown: uncultivated organism
  REGION 1..127: note = MG1-301 RuvC-III domain
AETAWISRLAQKIADLTFGWQNGVDAAGRKRTIIVSGGLTARIRRKYGLNRLLNPDASSEEEAEKKNRSDKRHHALDAMTISFIPQWARDPDKTGFFRFPKEIRDNSLPFFKARIDAVVPRQLCYEK

SEQ ID NO: 2117 - protein, 127 aa, unidentified
  REGION 1..127: note = Description of Unknown: uncultivated organism
  REGION 1..127: note = MG1-302 RuvC-III domain
AETAWISRLAQKIADLAFGWHNGVDAAGRKRTVVVSGGLTARIRRKYGLNRILNPNVATEEEAEKKNRADKRHHALDAMTISFIPQWARDPDKTGFFRLPREIRDNPWPFFQARIDAVVPRQLCYEK

SEQ ID NO: 2118 - protein, 127 aa, unidentified; identical to SEQ ID NO: 2117
  REGION 1..127: note = Description of Unknown: uncultivated organism
  REGION 1..127: note = MG1-303 RuvC-III domain

SEQ ID NO: 2119 - protein, 173 aa, unidentified
  REGION 1..173: note = Description of Unknown: uncultivated organism with predicted taxonomy: Verrucomicrobia
  REGION 1..173: note = MG1-304 RuvC-III domain
AATSWIARITQSIVRLHFGWQLDDEPGKEKVMTISGGLTARIRRKYLLDSLLGTDKESQKVCEQVDQVLAEMEKLKSQPRSEETKVQWRELSQKRSQLARDSEKNRGDQRHHALDAMLLTFLPNWARDRNKEDFLRLEDIGDNAPYTDEGKRNAEKITDEIKKLVEETKPIYK

SEQ ID NO: 2120 - protein, 127 aa, unidentified
  REGION 1..127: note = Description of Unknown: uncultivated organism with predicted taxonomy: Verrucomicrobia bacterium IMCC26134
  REGION 1..127: note = MG1-305 RuvC-III domain
AETAWISRLAQKIADLSFGWQNGVDAAGRKRTIVVSGGLTARIRRKYGLNRLLNPNATSEEEAEKKNRADKRHHALDAMTISFIPQWARDPDKTGFFRFPKEIRDNPHPFFQARIEAVVPRQLCYEK

SEQ ID NO: 2121 - protein, 123 aa, unidentified
  REGION 1..123: note = Description of Unknown: uncultivated organism with predicted taxonomy: Verrucomicrobia
  REGION 1..123: note = MG1-306 RuvC-III domain
AETAWISKLAQTIIGLRFGWPNGIANGERKVIVISGGLTGRIRRKYKLNSLLNPDAKSEEEAEIKNRGDDRHHALDAMVISFLPTWARNSRFTGFFRFPDEVTRELFKREIAEVIPQNVCFER

SEQ ID NO: 2122 - protein, 198 aa, unidentified
  REGION 1..198: note = Description of Unknown: uncultivated organism with predicted taxonomy: Verrucomicrobia bacterium IMCC26134
  REGION 1..198: note = MG1-307 RuvC-III domain
QQTAYIARCLREACLIHFGKEWLDWTDGAGRDPLLLPDNRASKSYLTTSGATTARLRGAWHLNEILWPKPQRLNDAEWDKLTDEEKTILKAKYKEERAVRALKNRQDHRHHALDAMVISCAVPWQTFKVRLGNQQPEDGLCELDAETGEITKIWNPVFNDYGYGIMRAVESRMDLLLKFSTDRQTDLLRHHKSSQRNA

SEQ ID NO: 2123 - protein, 127 aa, unidentified
  REGION 1..127: note = Description of Unknown: uncultivated organism
  REGION 1..127: note = MG1-308 RuvC-III domain
QLARQLRRMICFWMGIQEDSKETRERIGNPSGLHTAAARRGWKITKDRSDLTHHRMDAAVLSFIPPGAGLNSVMYGGIFEEVHSTKEINGNKFKVVQMRGAPELKPDLSALKKDSLTECPVINIRSK

SEQ ID NO: 2124 - protein, 152 aa, unidentified
  REGION 1..152: note = Description of Unknown: uncultivated organism
  REGION 1..152: note = MG1-309 RuvC-III domain
QLARELRRRVVEWLGIERRHAGIADPTQRALAREAEERRRVAAPAGALTAACREAWKDRLPEAYFTPIEIRGQTVLTKNRGNLRHHMWDAGVLAHIPPGDGLNHVRYGGIFETADIGGAPRPVPLPELAPDLAEIEKADPLACRVFHLRPRH

SEQ ID NO: 2125 - protein, 137 aa, unidentified
  REGION 1..137: note = Description of Unknown: uncultivated organism
  REGION 1..137: note = MG1-310 RuvC-III domain
QLARQLRAEIMRWMQVDDKPDEAARRIGTPSGWLAAQARKSWLPAEEYEKVRNNVTHHLIDAAILAHIPPREGMNSVPCKGIFYVESVPVRDPVTGDTTYRLETKALPELSPLPRLKHWLPDNGEYDVCPVWKPRRQ

SEQ ID NO: 2126 - protein, 137 aa, unidentified
  REGION 1..137: note = Description of Unknown: uncultivated organism
  REGION 1..137: note = MG1-311 RuvC-III domain
QLARQLRAEVMRWMQVEDQPDEAARRIGTPSGWLAAQARKSWLAAIDYQKVRNNLTHHLIDAAVLAHIPPREGMNSVICKGIFYVEREPVRDEATGITSHRFVTKALPELSALPRIKQWLPDNGEYAVCPVLKPRRQ

SEQ ID NO: 2127 - protein, 137 aa, unidentified; identical to SEQ ID NO: 2126
  REGION 1..137: note = Description of Unknown: uncultivated organism
  REGION 1..137: note = MG1-312 RuvC-III domain

SEQ ID NO: 2128 - protein, 127 aa, unidentified; identical to SEQ ID NO: 2123
  REGION 1..127: note = Description of Unknown: uncultivated organism
  REGION 1..127: note = MG1-314 RuvC-III domain

SEQ ID NO: 2129 - protein, 137 aa, unidentified
  REGION 1..137: note = Description of Unknown: uncultivated organism with predicted taxonomy: Verrucomicrobia bacterium
  REGION 1..137: note = MG1-315 RuvC-III domain
QLARQLRAEVMRWMHVEDQPDEAARRIGTPSGWLVAQARKSWLAASDYQKVRNNLTHHLIDAAVLAHIPPREGMNSIICKGIFYDVRERVRDEATGITSHRFLTKALPELSPLPRLKQWLPDNGEYAVCPVLKPRHQ

SEQ ID NO: 2130 - protein, 198 aa, unidentified; identical to SEQ ID NO: 2092
  REGION 1..198: note = Description of Unknown: uncultivated organism with predicted taxonomy: Thiorhodospira sibirica
  REGION 1..198: note = MG1-316 RuvC-III domain

SEQ ID NO: 2131 - protein, 137 aa, unidentified
  REGION 1..137: note = Description of Unknown: uncultivated organism
  REGION 1..137: note = MG1-317 RuvC-III domain
QLARQLRAEVMRWMKVEGDPDEAARRIGTPSGWLAAQARKSWLAQGDYEKVRNNLTHHLIDAAVLAHIPPREGMNSVLYKGIFYVVREPVRNEITGTTSQRLLTKALPQLSPLPRLNHWLPDNGEYAVCPVLKPRRQ

SEQ ID NO: 2132 - protein, 137 aa, unidentified; identical to SEQ ID NO: 2126
  REGION 1..137: note = Description of Unknown: uncultivated organism
  REGION 1..137: note = MG1-318 RuvC-III domain

SEQ ID NO: 2133 - protein, 130 aa, unidentified
  REGION 1..130: note = Description of Unknown: uncultivated organism with predicted taxonomy: Verrucomicrobia bacterium IMCC26134
  REGION 1..130: note = AKC83434.1 RuvC-III domain
AETAYIARLAQTVAALHFGWPINSQPGERRITIVNGGLTARVRRNYRLNSLLNPCPTGKDQKEWEEDADVEKNRKDDRHHALDAMVISFIPAWTRDPKKEKFFRLPDGVTPETFQERLEEVLPRQLHYER

SEQ ID NO: 2134 - protein, 130 aa, unidentified; identical to SEQ ID NO: 2133
  REGION 1..130: note = Description of Unknown: uncultivated organism with predicted taxonomy: Verrucomicrobia bacterium IMCC26134
  REGION 1..130: note = AKC83434.1 RuvC-III domain

SEQ ID NO: 2135 - protein, 123 aa, unidentified
  REGION 1..123: note = Description of Unknown: uncultivated organism with predicted taxonomy: Verrucomicrobia bacterium 61-8
  REGION 1..123: note = OJV06180.1 RuvC-III domain
AETAWIAKLSQAILDAFFGWKNGVDDEGRKRVISVNGGLTARIRRKYQLNSILNPSLNEEEAEKKNRSDKRHHALDAMVINFIPSWTRDTAKEHFFRFPSGIHRETFVQQIANVTPRNLCLEK

SEQ ID NO: 2136 - protein, 123 aa, unidentified; identical to SEQ ID NO: 2135
  REGION 1..123: note = Description of Unknown: uncultivated organism with predicted taxonomy: Verrucomicrobia bacterium 61-8
  REGION 1..123: note = OJV06180.1 RuvC-III domain

SEQ ID NO: 2137 - protein, 137 aa, unidentified
  REGION 1..137: note = Description of Unknown: uncultivated organism with predicted taxonomy: Pedosphaera sp. Tous-C6FEB
  REGION 1..137: note = PAW75411.1 RuvC-III domain
AETAWVSKLAQAIVNLTFGWTNANDEEGRKRVIVVSGGLTARVRRKYSLDKLLYTNTTDPEVLTKQVKNRSDKRHHALDAMVLTYIPQWARDPGKEGFFRFPAEFRDATGREDYSAIQRLFKDKLAKTTPRFLAYER

SEQ ID NO: 2138 - protein, 137 aa, unidentified; identical to SEQ ID NO: 2137
  REGION 1..137: note = Description of Unknown: uncultivated organism with predicted taxonomy: Pedosphaera sp. Tous-C6FEB
  REGION 1..137: note = PAW75411.1 RuvC-III domain

SEQ ID NO: 2139 - protein, 130 aa, unidentified; identical to SEQ ID NO: 2133
  REGION 1..130: note = Description of Unknown: uncultivated organism with predicted taxonomy: Verrucomicrobia bacterium IMCC26134
  REGION 1..130: note = WP_082083265.1 RuvC-III domain

SEQ ID NO: 2140 - protein, 130 aa, unidentified; identical to SEQ ID NO: 2133
  REGION 1..130: note = Description of Unknown: uncultivated organism with predicted taxonomy: Verrucomicrobia bacterium IMCC26134
  REGION 1..130: note = WP_082083265.1 RuvC-III domain

SEQ ID NO: 2141 - protein, 156 aa, unidentified; identical to SEQ ID NO: 1899
  REGION 1..156: note = Description of Unknown: uncultivated organism
  REGION 1..156: note = MG2-1 RuvC-III domain

SEQ ID NO: 2142 - protein, 174 aa, unidentified
  REGION 1..174: note = Description of Unknown: uncultivated organism
  REGION 1..174: note = MG2-7 RuvC-III domain
TQTSHLNKMAIRLVKQRIGIDAKHLPGNVTAFIRQKLHIDECLFNAVPRLQTAAKGQPKSSKRKKKAEEAPVEPIQDDMPPRKLTKADIRELTYLHHAMDAVTQGLALLLFAPEDWPLLVKRNLPDSEQRHLKARYPFLDFSADKHISIQDLPEDTLHTISERLAECRVVRHIP

SEQ ID NO: 2143 - protein, 206 aa, unidentified
  REGION 1..206: note = Description of Unknown: uncultivated organism
  REGION 1..206: note = MG2-3 RuvC-III domain
TITSHLNRLAQQVLLRSLPHLAEHQITAIPGSVIGVLRDAPGWRLLGCLDGAATADVIRKVLQLDHEGKPMCASDVAPLMKRIPKPKGEIRELTHLHHAVDACAIAIINHLLPKDGKLWELVAKRELTDADKNAYDDLRQKNQSQWQPRRLARLFSIVPNLDDKGQQPKHDHKWRIRPCRLKDVLPDIGAQVNKCLRERRVVEHTP

SEQ ID NO: 2144 - protein, 161 aa, unidentified
  REGION 1..161: note = Description of Unknown: uncultivated organism with predicted taxonomy: Verrucomicrobia
  REGION 1..161: note = MG2-5 RuvC-III domain
TQTSQLVRLAAQALRRNLPHLGPENVVSLPGSVTGMVRKSWNVTGCLELACPQVMEEVVDQDGKAVRRAKDKGEIRGITHLHHALDACVIGFSSHFIPNNGGLWELMVKRRWTPAEEKELEARRVFSKGMDGRFQMTDLHKRHKEAIRQRLAEKRVVQHIP

SEQ ID NO: 2145 - protein, 153 aa, unidentified
  REGION 1..153: note = Description of Unknown: uncultivated organism with predicted taxonomy: Verrucomicrobia bacterium
  REGION 1..153: note = MG2-6 RuvC-III domain
TQTSQLVRLAAQVIRKKYVDSKEPKIVSMPGSVTAVFRKSWKVMGCLSKAVPAILDENGEVRPKDEIRNITHLHHAIDACVLALASHLFPNNGRLWELLVKNKLNSSEVDELKKIPLVQVGVDNKINISDLPEFIKEQISNRLLERRVVQHIS

SEQ ID NO: 2146 - protein, 154 aa, unidentified
  REGION 1..154: note = Description of Unknown: uncultivated organism with predicted taxonomy: Verrucomicrobia
  REGION 1..154: note = MG2-8 RuvC-III domain
TVTSQLVRLGALTLKREFADVKQPPVIVSLPGAVTGEVRKAWDVLGCLGLACSQVLDVEGKPKTKTEIRDITHLHHALDACVLGLASHFIPNNGRVWELITKRNLTSAEQKELIALNVFATGPQGRVQLRDLRPERKEQIRQRLAEKRVVQHIP

SEQ ID NO: 2147 - protein, 154 aa, unidentified; identical to SEQ ID NO: 2146
  REGION 1..154: note = Description of Unknown: uncultivated organism with predicted taxonomy: Verrucomicrobia
  REGION 1..154: note = MG2-10 RuvC-III domain

SEQ ID NO: 2148 - protein, 156 aa, unidentified
  REGION 1..156: note = Description of Unknown: uncultivated organism
  REGION 1..156: note = MG2-11 RuvC-III domain
TQTSQLVRLGAQILKKGFTGLERQPVITSMPGSVTGVMRKGWNLIGCLSAANPNVLDEIGQPKIKTEIRDITHLHHALDACVLVLASYFIPNKGAVWELIVKRRLDETEQLQLRTATRGIFNFSPGRRFGLADLPNSLKEQIRQRLAERRVVQHVP

SEQ ID NO: 2149 - protein, 28 aa, unidentified
  REGION 1..28: note = Description of Unknown: uncultivated organism with predicted taxonomy: Verrucomicrobia bacterium
  REGION 1..28: note = MG2-12 RuvC-III domain
TKTRFINKLAAQQLQAAFRDLPEQQRPP

SEQ ID NO: 2150 - protein, 156 aa, unidentified
  REGION 1..156: note = Description of Unknown: uncultivated organism with predicted taxonomy: Verrucomicrobia bacterium
  REGION 1..156: note = MG2-13 RuvC-III domain
TQTSQLVRLGAQVLKKGFTGLERQPVITSMPGSVTGVMRKGWNLIGCLSAANPNVLDEIGQPKIKTEIRDITHLHHALDACVLALVSHFIPNNGGVWELIVKRRLDETEQLQLRAATHGIFNFSPGRRFGLADLPDSLKEQIRQRLAERRVVQHVP

SEQ ID NO: 2151 - protein, 156 aa, unidentified
  REGION 1..156: note = Description of Unknown: uncultivated organism with predicted taxonomy: Verrucomicrobia bacterium
  REGION 1..156: note = MG2-14 RuvC-III domain
SQTSYLNKLAVQQANHWFRQQLGLDTKLPLVIQLSGSVTAAIRTGWDLFGQLNEVCPATRNKTKTEVREITHLHHALDAIVIGLSAHYFPRDKRLWSLMSRRAVKNSVDQAYMKQQLGDLVCFNSDGKWKLQELDIGIKKQVAARLSEKRVVRHNP

SEQ ID NO: 2152 - protein, 156 aa, unidentified; identical to SEQ ID NO: 2151
  REGION 1..156: note = Description of Unknown: uncultivated organism with predicted taxonomy: Verrucomicrobia bacterium
  REGION 1..156: note = MG2-15 RuvC-III domain

SEQ ID NO: 2153 - protein, 153 aa, unidentified
  REGION 1..153: note = Description of Unknown: uncultivated organism with predicted taxonomy: Verrucomicrobia bacterium
  REGION 1..153: note = MG2-16 RuvC-III domain
TQTSQLARMAAQMVKRTFQDVEQKPVIVSMPGSVTSTVRKGWDLLGCLSKACPEVLDETGQVKTKSEIRDITHLHHALDACVLGLAAHFIPNNGDIWKLIIKQDLNETEKDLLRPLGIFDIGEKRFRLKDLPNELKNQLRERLAELRVVQHIP

SEQ ID NO: 2154 - protein, 206 aa, unidentified; identical to SEQ ID NO: 2143
  REGION 1..206: note = Description of Unknown: uncultivated organism
  REGION 1..206: note = MG2-17 RuvC-III domain

SEQ ID NO: 2155 - protein, 153 aa, unidentified
  REGION 1..153: note = Description of Unknown: uncultivated organism with predicted taxonomy: Verrucomicrobia
  REGION 1..153: note = MG2-18 RuvC-III domain
TQTSQLVRLGAQMLKRPFLREKHQPVITSMPGSVTGEVRKGWNLLGCLSKACPQVLDENGEVRTKTEIREITHLHHALDACVLGLAAHFIPNNGRIWELIVKRNLTDTEKLQLRALGIFDFSPEGFRLKELPDELKNQIRERLAERRVVQHVP

SEQ ID NO: 2156 - protein, 156 aa, unidentified
  REGION 1..156: note = Description of Unknown: uncultivated organism with predicted taxonomy: Verrucomicrobia
  REGION 1..156: note = MG2-19 RuvC-III domain
TQTSQLVRLAVQVLKKKYIGEKEKPVFVSMPGSITGKFRAAWNLLGCLLKAVPWAADEDNQVKPKDELRNITHLHHAIDACVLALAGHFIPTYKNGKVWELMIKGTVKPSEKSYIEDVPMLQLDSENRLHIKDLPDSIKEQITERLYERRVVQHIP

SEQ ID NO: 2157 - protein, 189 aa, unidentified
  REGION 1..189: note = Description of Unknown: uncultivated organism with predicted taxonomy: Verrucomicrobia bacterium
  REGION 1..189: note = MG2-20 RuvC-III domain
TVTSHLVRLGAQVLQRAFPPEQRPPVISLPGSVTGEVRKAWKVTACLEAANPAVMEVVEEPDPQTGEMRRIRRAKKKEDIRGITHLHHALDACVLGLASLYFPRHGAVWSAAVKAGQHAATEYDNNEHPLWQAMTKRRPTAQEVVLLKATGLYDGPDSNGRMQLRDLPAELKGQIRRRLAEKRVVQHIP

SEQ ID NO: 2158 - protein, 156 aa, unidentified
  REGION 1..156: note = Description of Unknown: uncultivated organism
  REGION 1..156: note = MG2-21 RuvC-III domain
TQTSQLVRLAVQVLMKKYIGEKEKPVFVSMPGSITGKFRAGWNLLGCLLKAVPWAADEDNQVKPKDELRNITHLHHAIDACVLALAAHFIPTYKNGKVWELMFKGTVKPSEKMYIEDVPVLQLDSENRLHIKDLPDSIKEQITERLYERRVVQHIP

SEQ ID NO: 2159 - protein, 206 aa, unidentified; identical to SEQ ID NO: 2143
  REGION 1..206: note = Description of Unknown: uncultivated organism
  REGION 1..206: note = MG2-22 RuvC-III domain

SEQ ID NO: 2160 - protein, 152 aa, unidentified
  REGION 1..152: note = Description of Unknown: uncultivated organism with predicted taxonomy: Verrucomicrobia bacterium
  REGION 1..152: note = MG2-23 RuvC-III domain
TQTSQLVRLGAQMLKRPFLGEKHQPVITSLPGSVTGVVRKGWNLLGCLSKACPQVLDETGEVRTKTDIREITHLHHAVDACVLGLAAHFVPNNGRMELIVKRNLTETEKLQLRALGVFDFSPDGFRLKELPEGLKNQIRDRLAERRVVQHIP

SEQ ID NO: 2161 - protein, 185 aa, unidentified
  REGION 1..185: note = Description of Unknown: uncultivated organism with predicted taxonomy: Verrucomicrobia bacterium
  REGION 1..185: note = MG2-24 RuvC-III domain
TVTSHLVRLGAQVLQRVFPKDQRPPVVSLPGSVTGEVRKAWRLTGCLEAANPAVMEEVQERNPDTGELQTVRRPKKKDEIRGITHLHHALDACVLGLASLCFPRHGAVWSAMVKAGGDREADDDRRLWLAMTKRRPTPQEATLLKATGRYQQDSEGRLHLADLDEQLKQQIRARLAEKRVVQHVP

SEQ ID NO: 2162 - protein, 175 aa, unidentified
  REGION 1..175: note = Description of Unknown: uncultivated organism
  REGION 1..175: note = MG2-25 RuvC-III domain
TLTSQLVRLGAQVIKRFFAGGARVNNPREAPTDSTARGFVNPRSGPRITSLPGAVTGAVRKGWRVLGCLAQAAPQILEPTGEPKSKTDIRDLTHLHHALDACVLALAAHYFPKDGSLWEAMIVRAPNAAQKQLLHATGFYEFIAEDKPNLKDLPIELKQQIANRLAEKRVVQHIP

SEQ ID NO: 2163 - protein, 156 aa, unidentified
  REGION 1..156: note = Description of Unknown: uncultivated organism with predicted taxonomy: Verrucomicrobia bacterium
  REGION 1..156: note = MG2-26 RuvC-III domain
TQTSQLVRLGAQVLQRAYLGLARPPVVTSLPGSVTGTVRKGWDLLGCLATANPGVLDESGEVKNKTEIRDITHLHHALDACVLALAARAIPNNGRVWELLTRRDNGLNEVERQQLLALGIYARDSEGRLVLRDLSPDLNEQVRQRLAERRVVQHIP

SEQ ID NO: 2164 - protein, 161 aa, unidentified
  REGION 1..161: note = Description of Unknown: uncultivated organism
  REGION 1..161: note = MG2-27 RuvC-III domain
TQTSHLVRLAAEELKKEFGGVQCSTRIVSMPGSVTAETRKAWKLEACLAQANPEVAELRERRKTEPAPVSIKQELRDISHLHHALDACVLACAAHYLEKKGNIWKALVQRRKSEAENLELLSTGLFKRGQDGQARLQDLPAQLKNQISRVLAECRVVQHIP

SEQ ID NO: 2165 - protein, 154 aa, unidentified
  REGION 1..154: note = Description of Unknown: uncultivated organism with predicted taxonomy: Verrucomicrobia
  REGION 1..154: note = MG2-28 RuvC-III domain
TQTSQLARLAAQILRTPFNDTSNPPEIVSLPGFVTATVRRSWDVLGCLSQAAPGVLNTDGSTRSKTEIRNITHLHHALDACVIGLASHFIPNRGDVWRLLAQRNLRAWEKQQLADLGVFDFDAHGGLRLRDLPQQLKEQLRQRLTERRVVQHVP

SEQ ID NO: 2166 - protein, 152 aa, unidentified
  REGION 1..152: note = Description of Unknown: uncultivated organism with predicted taxonomy: Verrucomicrobia bacterium
  REGION 1..152: note = MG2-29 RuvC-III domain
TISSYVAKLAVGQIKKEFSELSKKPPVISLPGRLTGEARKSWKLLGLLSAVNENITSETPKNDIRGLTHLHHAMDAAVMGLMAHCADNLSDGTSWQLLLKRNLRPEEKNLLKANMRNIGFDGNRAHLLDVPNEIKEQLRRCLLERRVVQHVP

SEQ ID NO: 2167 - protein, 153 aa, unidentified
  REGION 1..153: note = Description of Unknown: uncultivated organism with predicted taxonomy: Verrucomicrobia bacterium
  REGION 1..153: note = MG2-30 RuvC-III domain
TLTSYVTKLALQQIKNQFDTCRKKPQVIALPGRLTGETRKTWKLMGLLHVVNEKIDGKTLKNDIRSMSHLHHAIDATIMGLLAYYIKDLADGTTWQLLLKRYLTASEIQHLKDNLNHFKIDSKNRAHLCDIPSHVQKQIEQCLKERRVVQHVP

SEQ ID NO: 2168 - protein, 153 aa, unidentified; identical to SEQ ID NO: 2167
  REGION 1..153: note = Description of Unknown: uncultivated organism with predicted taxonomy: Verrucomicrobia bacterium
  REGION 1..153: note = MG2-31 RuvC-III domain

SEQ ID NO: 2169 - protein, 153 aa, unidentified; identical to SEQ ID NO: 2167
  REGION 1..153: note = Description of Unknown: uncultivated organism with predicted taxonomy: Verrucomicrobia bacterium
  REGION 1..153: note = MG2-32 RuvC-III domain

SEQ ID NO: 2170 - protein, 66 aa, unidentified
  REGION 1..66: note = Description of Unknown: uncultivated organism with predicted taxonomy: Verrucomicrobia bacterium
  REGION 1..66: note = MG2-33 RuvC-III domain
TLTSYVTKLALQQIKNQFDTCRKKPQVIALPGRLTGETRKTWKLMGLLHVVNEKIDGKTLKNDIRS

SEQ ID NO: 2171 - protein, 66 aa, unidentified; identical to SEQ ID NO: 2170
  REGION 1..66: note = Description of Unknown: uncultivated organism with predicted taxonomy: Verrucomicrobia bacterium
  REGION 1..66: note = MG2-34 RuvC-III domain

SEQ ID NO: 2172 - protein, 156 aa, unidentified
  REGION 1..156: note = Description of Unknown: uncultivated organism with predicted taxonomy: Thermogutta terrifontis
  REGION 1..156: note = MG2-35 RuvC-III domain
TQTSYLNKLAAQQVQRWFSDQLDEDVKLPPVVQLSGSVTAAVRRSWDLFDQLQQVCPETRGKSKSDIRGMTHLHHALDAVTVGLAAHLFPKDGHLWALMSKRKITRPSDRDYMRSRLGDLVSFNNDGKWRLEALPESLLFEVAGKLAEQRVVRHMP

SEQ ID NO: 2173 - protein, 157 aa, unidentified
  REGION 1..157: note = Description of Unknown: uncultivated organism with predicted taxonomy: Coraliomargarita sp. CAG:312
  REGION 1..157: note = MG2-36 RuvC-III domain
TQTSHLNKLAFKVVKSLYADAEKAPELIHVPGIVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2174 - protein, 94 aa, unidentified
  REGION 1..94: note = Description of Unknown: uncultivated organism with predicted taxonomy: Coraliomargarita sp. CAG:312
  REGION 1..94: note = MG2-37 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGE

SEQ ID NO: 2175 - protein, 157 aa, unidentified
  REGION 1..157: note = Description of Unknown: uncultivated organism with predicted taxonomy: Coraliomargarita sp. CAG:312
  REGION 1..157: note = MG2-38 RuvC-III domain
TQTSHLNKLAFKVVKSLYADAEKAPELIHVPGTVTSVVRKNWDLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2176 - protein, 202 aa, unidentified
  REGION 1..202: note = Description of Unknown: uncultivated organism with predicted taxonomy: Verrucomicrobia bacterium
  REGION 1..202: note = MG2-39 RuvC-III domain
TQTSHLNKLAFKVVDSLYVDSEEKPELVHLPGSVTSVLRTNWDLSACMAKACPEIIVTVKSADSASGERGMGGDGLPQGLNGSVTDTAACCGGEADAPQSGGSSGGEKKVLLMKGKIRSITHLHHAVDAVAIGLAAAVFPHTNRFYELVSKRNLNRSEREELYRTGLFVFSERNWRLKELPAKLINEISDRIAEGRVVKYLP

SEQ ID NO: 2177 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-40 RuvC-III domain

SEQ ID NO: 2178 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-41 RuvC-III domain

SEQ ID NO: 2179 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-42 RuvC-III domain

SEQ ID NO: 2180 - protein, 202 aa, unidentified; identical to SEQ ID NO: 2176
  REGION 1..202: note = Description of Unknown: uncultivated organism with predicted taxonomy: Verrucomicrobia
  REGION 1..202: note = MG2-43 RuvC-III domain

SEQ ID NO: 2181 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-44 RuvC-III domain

SEQ ID NO: 2182 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-45 RuvC-III domain

SEQ ID NO: 2183 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-46 RuvC-III domain

SEQ ID NO: 2184 - protein, 202 aa, unidentified; identical to SEQ ID NO: 2176
  REGION 1..202: note = Description of Unknown: uncultivated organism with predicted taxonomy: Verrucomicrobia bacterium
  REGION 1..202: note = MG2-47 RuvC-III domain

SEQ ID NO: 2185 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-48 RuvC-III domain

SEQ ID NO: 2186 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-49 RuvC-III domain

SEQ ID NO: 2187 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-50 RuvC-III domain

SEQ ID NO: 2188 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-51 RuvC-III domain

SEQ ID NO: 2189 - protein, 202 aa, unidentified; identical to SEQ ID NO: 2176
  REGION 1..202: note = Description of Unknown: uncultivated organism with predicted taxonomy: Verrucomicrobia bacterium
  REGION 1..202: note = MG2-52 RuvC-III domain

SEQ ID NO: 2190 - protein, 202 aa, unidentified; identical to SEQ ID NO: 2176
  REGION 1..202: note = Description of Unknown: uncultivated organism with predicted taxonomy: Verrucomicrobia bacterium
  REGION 1..202: note = MG2-53 RuvC-III domain

SEQ ID NO: 2191 - protein, 135 aa, unidentified
  REGION 1..135: note = Description of Unknown: uncultivated organism with predicted taxonomy: Coraliomargarita sp. CAG:312
  REGION 1..135: note = MG2-54 RuvC-III domain
TQTSHLNKLAFKLVKSLYVDAGKTPELVHLPGSVTSAVRKNWELLPCMGDVCPEIYETLENGDKVLLLKDKIRSITHLHHAVDAVAMGLAASVFPRTKRFYEAVSKRHLSEADREELLNTGLVLFSDDKWKLVEL

SEQ ID NO: 2192 - protein, 157 aa, unidentified; identical to SEQ ID NO: 2175
  REGION 1..157: note = Description of Unknown: uncultivated organism with predicted taxonomy: Coraliomargarita sp. CAG:312
  REGION 1..157: note = MG2-55 RuvC-III domain

SEQ ID NO: 2193 - protein, 157 aa, unidentified
  REGION 1..157: note = Description of Unknown: uncultivated organism with predicted taxonomy: Coraliomargarita sp. CAG:312
  REGION 1..157: note = MG2-56 RuvC-III domain
TQTSHLNKLAFKVVKSLYADAEKAPELIHVPGIVTSVVRKNWNLLPCMGDACPEIYETLENGDKVLRLKDEIRSITHLHHAVDAVAMGLAASVFPRTRNFYEAVSKRRLNQADRQELLKTGLVLFSGDKWKLVELEKSYLKEISGRISENRVVKFLP

SEQ ID NO: 2194 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-57 RuvC-III domain

SEQ ID NO: 2195 - protein, 202 aa, unidentified; identical to SEQ ID NO: 2176
  REGION 1..202: note = Description of Unknown: uncultivated organism with predicted taxonomy: Verrucomicrobia bacterium
  REGION 1..202: note = MG2-58 RuvC-III domain

SEQ ID NO: 2196 - protein, 157 aa, unidentified; identical to SEQ ID NO: 2175
  REGION 1..157: note = Description of Unknown: uncultivated organism with predicted taxonomy: Coraliomargarita sp. CAG:312
  REGION 1..157: note = MG2-59 RuvC-III domain

SEQ ID NO: 2197 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-60 RuvC-III domain

SEQ ID NO: 2198 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-61 RuvC-III domain

SEQ ID NO: 2199 - protein, 155 aa, unidentified
  REGION 1..155: note = Description of Unknown: uncultivated organism with predicted taxonomy: Verrucomicrobia
  REGION 1..155: note = MG2-62 RuvC-III domain
TQTSHLNKLAIRLVKRELGIDARHLAGAVTGFVRKNLSIDECLVAAVPRMQRAQRVSEHDSRKLLKSQMRELSHLHHAMDAITQGLTGILFRVEDWKLLVKRHLTERERAVLAAKYPTLLRFSANGEIALKPLPDSLLSEITARLKECRVVQHVP

SEQ ID NO: 2200 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-63 RuvC-III domain

SEQ ID NO: 2201 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-64 RuvC-III domain

SEQ ID NO: 2202 - protein, 202 aa, unidentified; identical to SEQ ID NO: 2176
  REGION 1..202: note = Description of Unknown: uncultivated organism with predicted taxonomy: Coraliomargarita sp. CAG:312
  REGION 1..202: note = MG2-65 RuvC-III domain

SEQ ID NO: 2203 - protein, 157 aa, unidentified; identical to SEQ ID NO: 2175
  REGION 1..157: note = Description of Unknown: uncultivated organism with predicted taxonomy: Coraliomargarita sp. CAG:312
  REGION 1..157: note = MG2-66 RuvC-III domain

SEQ ID NO: 2204 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-67 RuvC-III domain

SEQ ID NO: 2205 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-68 RuvC-III domain

SEQ ID NO: 2206 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-69 RuvC-III domain

SEQ ID NO: 2207 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-70 RuvC-III domain

SEQ ID NO: 2208 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-71 RuvC-III domain

SEQ ID NO: 2209 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-72 RuvC-III domain

SEQ ID NO: 2210 - protein, 202 aa, unidentified; identical to SEQ ID NO: 2176
  REGION 1..202: note = Description of Unknown: uncultivated organism with predicted taxonomy: Verrucomicrobia bacterium
  REGION 1..202: note = MG2-73 RuvC-III domain

SEQ ID NO: 2211 - protein, 155 aa, unidentified; identical to SEQ ID NO: 2199
  REGION 1..155: note = Description of Unknown: uncultivated organism with predicted taxonomy: Verrucomicrobia
  REGION 1..155: note = MG2-74 RuvC-III domain

SEQ ID NO: 2212 - protein, 157 aa, unidentified; identical to SEQ ID NO: 2173
  REGION 1..157: note = Description of Unknown: uncultivated organism with predicted taxonomy: Coraliomargarita sp. CAG:312
  REGION 1..157: note = MG2-75 RuvC-III domain

SEQ ID NO: 2213 - protein, 136 aa, unidentified
  REGION 1..136: note = Description of Unknown: uncultivated organism with predicted taxonomy: Verrucomicrobia bacterium
  REGION 1..136: note = MG2-76 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPDR

SEQ ID NO: 2214 - protein, 154 aa, unidentified
  REGION 1..154: note = Description of Unknown: uncultivated organism
  REGION 1..154: note = MG2-77 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLNDLKPERKEQIRQRLAERRVVQHIP

SEQ ID NO: 2215 - protein, 154 aa, unidentified; identical to SEQ ID NO: 2214
  REGION 1..154: note = Description of Unknown: uncultivated organism with predicted taxonomy: Verrucomicrobia bacterium
  REGION 1..154: note = MG2-78 RuvC-III domain

SEQ ID NO: 2216 - protein, 154 aa, unidentified
  REGION 1..154: note = Description of Unknown: uncultivated organism with predicted taxonomy: Verrucomicrobia bacterium
  REGION 1..154: note = MG2-79 RuvC-III domain
TQTSQLVRLGGQVLKRAFANSEEKPTLVSLPGSVTGAVRKAWKVLGCLSLANQQVLDENGDVKTKTDIRDITHLHHALDACVLGLTSHFIPNNGRVWELIVKRNPNDLERQQLMALGVFGFNAEKRFEMRDLDNKLKEQIRQRLAEKRVVQHIP

SEQ ID NO: 2217 - protein, 154 aa, unidentified; identical to SEQ ID NO: 2214
  REGION 1..154: note = Description of Unknown: uncultivated organism with predicted taxonomy: Verrucomicrobia bacterium
  REGION 1..154: note = MG2-80 RuvC-III domain

SEQ ID NO: 2218 - protein, 110 aa, unidentified
  REGION 1..110: note = Description of Unknown: uncultivated organism with predicted taxonomy: Verrucomicrobia bacterium
  REGION 1..110: note = MG2-81 RuvC-III domain
TVTSQLVRLGAQIIKKTFAGSEKPPMVVSLPGSVTGTVRKGWNLLGCLELAAPQVKEADGGIKNKTDIRDVTHLHHALDACVLGLASYYLPNNGGLWEVMIKRNPNDGEK

SEQ ID NO: 2219 - protein, 154 aa, unidentified
  REGION 1..154: note = Description of Unknown: uncultivated organism with predicted taxonomy: Verrucomicrobia bacterium
  REGION 1..154: note = MG2-82 RuvC-III domain
TVTSQLVRLGAQALKREFIDLEEPPVTVSLPGAVTGEVRKAWDVLGCLSKACPEVLDAEGKVKTKTEIRDITHLHHALDACVIGLAAHFIPNRGRVWELITKRRLTAAEQSELVALKVFTPESHGEVRLKDLKPERKEQIRQRLAERRVVQHIP

SEQ ID NO: 2220 - protein, 157 aa, unidentified
  REGION 1..157: note = Description of Unknown: uncultivated organism
  REGION 1..157: note = MG2-83 RuvC-III domain
TQTSQLVRLGAQVLKKNLPHLTTGDVTSLPGSVTGTVRKGWKLEACLGLANPQVFDGNGGAKTKTEIRDITHLHHALDACVLGIAANYFQNQKLGASSLWELLIKRKYNEQEKTILRALGIFQFDKEGNSQIKELPKEIREQIRQRLAEKRVVQHIP

SEQ ID NO: 2221 - protein, 154 aa, unidentified; identical to SEQ ID NO: 2146
  REGION 1..154: note = Description of Unknown: uncultivated organism with predicted taxonomy: Verrucomicrobia bacterium
  REGION 1..154: note = MG2-84 RuvC-III domain

SEQ ID NO: 2222 - protein, 154 aa, unidentified; identical to SEQ ID NO: 2214
  REGION 1..154: note = Description of Unknown: uncultivated organism with predicted taxonomy: Verrucomicrobia bacterium
  REGION 1..154: note = MG2-85 RuvC-III domain

SEQ ID NO: 2223 - protein, 154 aa, unidentified; identical to SEQ ID NO: 2146
  REGION 1..154: note = Description of Unknown: uncultivated organism
  REGION 1..154: note = MG2-86 RuvC-III domain

SEQ ID NO: 2224 - protein, 154 aa, unidentified; identical to SEQ ID NO: 2146
  REGION 1..154: note = Description of Unknown: uncultivated organism with predicted taxonomy: Methylococcales bacterium
  REGION 1..154: note = MG2-87 RuvC-III domain

SEQ ID NO: 2225 - protein, 154 aa, unidentified; identical to SEQ ID NO: 2146
  REGION 1..154: note = Description of Unknown: uncultivated organism
  REGION 1..154: note = MG2-88 RuvC-III domain

SEQ ID NO: 2226 - protein, 154 aa, unidentified; identical to SEQ ID NO: 2146
  REGION 1..154: note = Description of Unknown: uncultivated organism with predicted taxonomy: Verrucomicrobia
  REGION 1..154: note = MG2-89 RuvC-III domain

SEQ ID NO: 2227 - protein, 72 aa, unidentified
  REGION 1..72: note = Description of Unknown: uncultivated organism with predicted taxonomy: Verrucomicrobia bacterium
  REGION 1..72: note = MG2-90 RuvC-III domain
TQTSQLVRLGAQVLKKNLPHLTTGDVTSLPGSVTGTVRKGWKLEACLGLANPQVFDGNGGAKTKTEIRDITH

SEQ ID NO: 2228 - protein, 157 aa, unidentified; identical to SEQ ID NO: 2220
  REGION 1..157: note = Description of Unknown: uncultivated organism
  REGION 1..157: note = MG2-91 RuvC-III domain

SEQ ID NO: 2229 - protein, 54 aa, unidentified
  REGION 1..54: note = Description of Unknown: uncultivated organism with predicted taxonomy: Verrucomicrobiae bacterium Tous-C5FEB
  REGION 1..54: note = MG2-92 RuvC-III domain
TVTSQLVRLGAQIIKKTFAENEKLPTVVSLPGSVTGTVRKGWNLLGCLATAAPQ

SEQ ID NO: 2230 - protein, 174 aa, unidentified
  REGION 1..174: note = Description of Unknown: uncultivated organism
  REGION 1..174: note = MG2-94 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSERRLLKSRYPYLVFTENSRMDIQDLPDATLKTISGRLAECRVVRHIP

SEQ ID NO: 2231 - protein, 174 aa, unidentified; identical to SEQ ID NO: 2230
  REGION 1..174: note = Description of Unknown: uncultivated organism
  REGION 1..174: note = MG2-95 RuvC-III domain

SEQ ID NO: 2232 - protein, 174 aa, unidentified; identical to SEQ ID NO: 2142
  REGION 1..174: note = Description of Unknown: uncultivated organism
  REGION 1..174: note = MG2-96 RuvC-III domain

SEQ ID NO: 2233 - protein, 173 aa, unidentified
  REGION 1..173: note = Description of Unknown: uncultivated organism with predicted taxonomy: Acidobacteria bacterium RIFCSPLOWO2_12_FULL_68_19
  REGION 1..173: note = MG2-97 RuvC-III domain
TQTSHLNKMAISLVKQRIGIDAKHLPGSVTAFIRQKLHIDECLFTAVPRLQKTAKGEGKRPKRKNADEVTAEPMQSDMPPRKLTKADIRELTHLHHAMDAVTQGLALLLFAPEDWPLLVKRNLTDSERRLLKSRYPYLVFTENSRMEIQDLPEATLKTISDRLAECRVIRHIP

SEQ ID NO: 2234 - protein, 154 aa, unidentified
  REGION 1..154: note = Description of Unknown: uncultivated organism with predicted taxonomy: Verrucomicrobia bacterium
  REGION 1..154: note = MG2-98 RuvC-III domain
TITSQLVRLGARTLEKAFTDGNHAPKIVSMPGSVTGRVQRAWSLMGCIAKANPSVLDENGKPKPKGDIRDISHLHHAVDACVLGIAGTLFPNDGSLWKAMAARSPARAEAEQLLATGLYERDSEKHLRLRDLPAALKNQIADRLSERRVYQHVS

SEQ ID NO: 2235 - protein, 174 aa, unidentified; identical to SEQ ID NO: 2142
  REGION 1..174: note = Description of Unknown: uncultivated organism
  REGION 1..174: note = MG2-99 RuvC-III domain

SEQ ID NO: 2236 - protein, 174 aa, unidentified; identical to SEQ ID NO: 2230
  REGION 1..174: note = Description of Unknown: uncultivated organism with predicted taxonomy: Proteobacteria
  REGION 1..174: note = MG2-100 RuvC-III domain

SEQ ID NO: 2237 - protein, 174 aa, unidentified
  REGION 1..174: note = Description of Unknown: uncultivated organism with predicted taxonomy: Bradyrhizobium
  REGION 1..174: note = MG2-101 RuvC-III domain
TQTSHLNKMAISLVKQRIGIDAKHLPGSVTAFIRQKLHIDECLFNAVPRLQKAAKGEGKKLKLKKNTEEPPAEPLLNDLPPRKLTKADIRELTHLHHAMDAVTQGLALLLFAPEDWPLLVKRHLSDSEKRLLKARYPFLLFNGDNNISIQDLPEAALQTISDRLAECRVVRHIP

SEQ ID NO: 2238 - protein, 154 aa, unidentified
  REGION 1..154: note = Description of Unknown: uncultivated organism with predicted taxonomy: Methylococcales bacterium
  REGION 1..154: note = MG2-102 RuvC-III domain
TQTSQLVRLGAQVLKRVFANSEKKSPVVSLPGSVTGAVRKAWKVLGCLSLANQQVLDENGDVKTKTDIRDITHLHHALDACVLGLTSHFIPNNGRVWELIVKRNPNELEKRELMALGVFGFNAEKRFEMRDLDNKLKEQIRQRLAEKRVVQHIP

SEQ ID NO: 2239 - protein, 153 aa, unidentified
  REGION 1..153: note = Description of Unknown: uncultivated organism with predicted taxonomy: Verrucomicrobia bacterium
  REGION 1..153: note = MG2-103 RuvC-III domain
TQTSQLVRLGAQVLRNVLPHLKQNDVISLPGSVTGTVRKAWKVLGCLSLANPQVLDENGDVKTKTDIRDITHLHHALDACVLGLVSHFIPNSGQVWELIVKRNPNDTEKKQLTALGVFGFGKDNRFEMRDLDDRLKEQIRQRLAEKRVVQHVP

SEQ ID NO: 2240 - protein, 158 aa, unidentified
  REGION 1..158: note = Description of Unknown: uncultivated organism with predicted taxonomy: Verrucomicrobia bacterium
  REGION 1..158: note = MG2-104 RuvC-III domain
TVTSHLVRLGAQVLKRHFSDLPREHRIQLEPVSLPGSVTGEIRKAWKLIGCLAVANPQVLNPDGTVKPKQDIRGITHLHHALDACVLGLAAFYFPRHGSLWAAMVKRRPSAEEAALLRQTGFYQTDSEGRFRLIDFPEVLAQQIRQRLAEKRVVQHVP

SEQ ID NO: 2241 - protein, 158 aa, unidentified; identical to SEQ ID NO: 2240
  REGION 1..158: note = Description of Unknown: uncultivated organism with predicted taxonomy: Verrucomicrobia bacterium
  REGION 1..158: note = MG2-105 RuvC-III domain

SEQ ID NO: 2242 - protein, 163 aa, unidentified
  REGION 1..163: note = Description of Unknown: uncultivated organism with predicted taxonomy: Rothia
  REGION 1..163: note = MG3-6 RuvC-III domain
ASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRP

SEQ ID NO: 2243 - protein, 159 aa, unidentified
  REGION 1..159: note = Description of Unknown: uncultivated organism with predicted taxonomy: Rothia
  REGION 1..159: note = MG3-7 RuvC-III domain
ASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRP

SEQ ID NO: 2244 - protein, 163 aa, unidentified
  REGION 1..163: note = Description of Unknown: uncultivated organism with predicted taxonomy: Rothia
  REGION 1..163: note = MG3-8 RuvC-III domain
ASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRP

SEQ ID NO: 2245 - protein, 145 aa, unidentified
  REGION 1..145: note = Description of Unknown: uncultivated organism with predicted taxonomy: Dermabacter hominis
  REGION 1..145: note = MG3-1 RuvC-III domain
ASTSYAATEITRRILGHFHDEVPVVAFGGSGTREARRAGRVDHIIRLRGSLDKSRLDTRHHAIDAAVLTLQSPAIYRVLLTRVNLKHEHEVTGEAPEWRDYEGADQAEKVLYRRWQKNIATLAELMRQEIENNRVPVTRPIRLRK

SEQ ID NO: 2246 - protein, 148 aa, unidentified
  REGION 1..148: note = Description of Unknown: uncultivated organism with predicted taxonomy: Micrococcales
  REGION 1..148: note = MG3-5 RuvC-III domain
SATAFAAVEIRRKLENHFKDRTKPVRVDVYRGALTRESRRAGRIDAKIRLRGNIDKDRLDIRHHAIDAAVLTLLDPSVAKTLAMRLDLKREQQDSGRDTRWKEFKGLTPASQERFIKWCQASECLADMLRQQIEADRVPVVVPLRISP

SEQ ID NO: 2247 - protein, 156 aa, unidentified
  REGION 1..156: note = Description of Unknown: uncultivated organism with predicted taxonomy: Rothia
  REGION 1..156: note = MG3-6 RuvC-III domain
ASTSYAATSIRERLEQHFNDDLPDGFAPVAVDVYGGSLTRESRRAGGIDKSIMLRGQSDKNRFDVRHHAIDAAVMTLLNPSVAVTLEQRRMLKQENDYSSPRGQHDNGWRDFIGRGEASQSKFLHWKKTAVVLADLISEAIEQDTIPVVNPLRLRP

SEQ ID NO: 2248 - protein, 163 aa, unidentified
  REGION 1..163: note = Description of Unknown: uncultivated organism with predicted taxonomy: Rothia
  REGION 1..163: note = MG3-7 RuvC-III domain
ASTSYAAVAVRERLEQHFNEGLAPDDKSRVVLDVYAGAVTRESRRAGGIDERILLRGERDKNRFDVRHHAIDAAVMTLLNRSVALTLEQRSQLRRAFYELELDKLDRDQLKPGEDWRNFTGLYEASQNKFSEWKKAATVLGDLLAEAIEDDAIAVVSPLRLRP

SEQ ID NO: 2249 - protein, 163 aa, unidentified; identical to SEQ ID NO: 2244
  REGION 1..163: note = Description of Unknown: uncultivated organism with predicted taxonomy: Rothia
  REGION 1..163: note = MG3-8 RuvC-III domain

SEQ ID NO: 2250 - protein, 152 aa, unidentified
  REGION 1..152: note = Description of Unknown: uncultivated organism with predicted taxonomy: Brevibacterium
  REGION 1..152: note = MG3-42 RuvC-III domain
ESTAYAATEIRRRLQYYFEENCGANSPQPEILVLPGAVTREARRAGGFDSRIKLRGKNDKDRFDARHHALDAAIMTVVDRSVARTLQQRSDLKYSNFLTGAEPRWKDFKGDSPESRKKFERWVQTSNRLADLVSDAIVTDSIPVIFPLRLGT

SEQ ID NO: 2251 - protein, 144 aa, unidentified
  REGION 1..144: note = Description of Unknown: uncultivated organism with predicted taxonomy: Brevibacterium mcbrellneri
  REGION 1..144: note = MG3-68 RuvC-III domain
ESTAYAATEIRRRVQYYFEENCGANVPQPEIFVLPGAVTREARRAGGFDSRIKLRGKGDKDRFDARHHALDAAIMTVVDWSVARTLQQRSDLKYSNFLTGAEPRWKEFKGDSPEARKKFERWIQTSNRLADLVSDAIVAAAIPV

SEQ ID NO: 2252 - protein, 152 aa, unidentified; identical to SEQ ID NO: 2250
  REGION 1..152: note = Description of Unknown: uncultivated organism with predicted taxonomy: Brevibacterium mcbrellneri
  REGION 1..152: note = MG3-88 RuvC-III domain

SEQ ID NO: 2253 - protein, 131 aa, unidentified
  REGION 1..131: note = Description of Unknown: uncultivated organism with predicted taxonomy: Planctomycetes
  REGION 1..131: note = MG4-5 RuvC-III domain
NDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRK

SEQ ID NO: 2254 - protein, 121 aa, unidentified
  REGION 1..121: note = Description of Unknown: uncultivated organism
  REGION 1..121: note = MG4-11 RuvC-III domain
TDTSYISKKAVEYVSLLFGGSIDAKGKRRVFATKGGITGRLRREWGLNVLLGGEDEKNRADHRHHAIDALVIALSTPAVIKKIGGEDTRPKEDILPPIDNLADVAREVLEKVNVVYRCSQK

SEQ ID NO: 2255 - protein, 148 aa, unidentified
  REGION 1..148: note = Description of Unknown: uncultivated organism
  REGION 1..148: note = MG4-12 RuvC-III domain
NDSRYMSKLALRYLGVLYGAVNGCVGGQDEDEGGKRVIFASTGKVTAWIRREWRLNEILCDDDEPTGEGADVEKNRNDHRHHAIDALVISLSTPSYVQQLNRAAQLADNDAKARLFKKGNFMPPVTGFKALVAQVVDGIVVSKRVDSK

SEQ ID NO: 2256 - protein, 134 aa, unidentified
  REGION 1..134: note = Description of Unknown: uncultivated organism
  REGION 1..134: note = MG4-13 RuvC-III domain
NDTKYASKLAKKFLGLLYPGQEALSRVQATKGGITANLRDVFNLNSILKDGDSVERDGYEPKKTRADHRHHAIDAICIALTEPSTVKMLSEASSRALKERKRRFGKVQPPWENFWEDVKKAIDNTIVSHRVSKK

SEQ ID NO: 2257 - protein, 130 aa, unidentified
  REGION 1..130: note = Description of Unknown: uncultivated organism
  REGION 1..130: note = MG4-14 RuvC-III domain
NDTAHASRSALRYLGLLYGSNKAGVGPDGRRRVQAGRGQVTAFLRDEWRLNSILGDLQKSRADHRHHAVDALAIALTDSRIIKTLSDAASRALSERRRRFGRVAPPWKSFLEEAKNAIAATIVSHRVSRK

SEQ ID NO: 2258 - protein, 128 aa, unidentified
  REGION 1..128: note = Description of Unknown: uncultivated organism with predicted taxonomy: Thermogutta terrifontis
  REGION 1..128: note = MG4-15 RuvC-III domain
SDTRWISKAAADYLGHLYGGRIDPTGQQRVFTVAGGLTGLFRRAWNLNAILGGSPEKNRYDHRHHAIDAIVVALTDPSMIQRFAHEASRLLKAWPRVAVRLDPPWSTFLSDVQRHVEGIVVSFRVSRR

SEQ ID NO: 2259 - protein, 128 aa, unidentified; identical to SEQ ID NO: 2258
  REGION 1..128: note = Description of Unknown: uncultivated organism with predicted taxonomy: Thermogutta terrifontis
  REGION 1..128: note = MG4-16 RuvC-III domain

SEQ ID NO: 2260 - protein, 128 aa, unidentified
  REGION 1..128: note = Description of Unknown: uncultivated organism with predicted taxonomy: Thermogutta terrifontis
  REGION 1..128: note = MG4-17 RuvC-III domain
NDTRWISKAAADYFGYLYGGRIAPTGQQRVFTVTGGLTALFRRAWNLNAVLGGNPEKNRYDHRHHAIDAIVVALTEPSMIQRFSNEAEKLIKAFPRVAVRLDPPWDTFLSDVQQHVERIVVSFRVNRR

SEQ ID NO: 2261 - protein, 128 aa, unidentified
  REGION 1..128: note = Description of Unknown: uncultivated organism with predicted taxonomy: Thermogutta terrifontis
  REGION 1..128: note = MG4-18 RuvC-III domain
SDTRWISKAAADYLGHLYGGRIDPTGQQRVFTVAGGLTGLFRRAWNLNAILGGSPEKNRYDHRHHAIDAIVVALTEPSMIQRFAHEASRLLKAWPRVAVRLDPPWSTFLSDVQRHVEGIVVSFRVSRR

SEQ ID NO: 2262 - protein, 141 aa, unidentified
  REGION 1..141: note = Description of Unknown: uncultivated organism
  REGION 1..141: note = MG4-19 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGFVDSIRPHFEQMLVSHRPEHR

SEQ ID NO: 2263 - protein, 141 aa, unidentified; identical to SEQ ID NO: 2262
  REGION 1..141: note = Description of Unknown: uncultivated organism
  REGION 1..141: note = MG4-20 RuvC-III domain

SEQ ID NO: 2264 - protein, 141 aa, unidentified; identical to SEQ ID NO: 2262
  REGION 1..141: note = Description of Unknown: uncultivated organism
  REGION 1..141: note = MG4-21 RuvC-III domain

SEQ ID NO: 2265 - protein, 141 aa, unidentified
  REGION 1..141: note = Description of Unknown: uncultivated organism with predicted taxonomy: Planctomyces sp. SH-PL14
  REGION 1..141: note = MG4-22 RuvC-III domain
NDTRYASKLACELVGTLFGGRDIPTESGSRQVVFASSGMVTATLRKGWGLEAILREAAPSANGQNRGKPRTDHRHHAIDAITIALSAPRMIAALSRNNAQDPYWPRNGRTAPKLQSPWNGIVDSIRPHFEQMLVSHRPEHR

SEQ ID NO: 2266 - protein, 141 aa, unidentified; identical to SEQ ID NO: 2262
  REGION 1..141: note = Description of Unknown: uncultivated organism
  REGION 1..141: note = MG4-23 RuvC-III domain

SEQ ID NO: 2267 - protein, 141 aa, unidentified; identical to SEQ ID NO: 2262
  REGION 1..141: note = Description of Unknown: uncultivated organism
  REGION 1..141: note = MG4-24 RuvC-III domain

SEQ ID NO: 2268 - protein, 141 aa, unidentified; identical to SEQ ID NO: 2262
  REGION 1..141: note = Description of Unknown: uncultivated organism
  REGION 1..141: note = MG4-25 RuvC-III domain

SEQ ID NO: 2269 - protein, 141 aa, unidentified; identical to SEQ ID NO: 2262
  REGION 1..141: note = Description of Unknown: uncultivated organism
  REGION 1..141: note = MG4-26 RuvC-III domain

SEQ ID NO: 2270 - protein, 141 aa, unidentified; identical to SEQ ID NO: 2262
  REGION 1..141: note = Description of Unknown: uncultivated organism
  REGION 1..141: note = MG4-27 RuvC-III domain

SEQ ID NO: 2271 - protein, 141 aa, unidentified; identical to SEQ ID NO: 2262
  REGION 1..141: note = Description of Unknown: uncultivated organism
  REGION 1..141: note = MG4-28 RuvC-III domain

SEQ ID NO: 2272 - protein, 141 aa, unidentified; identical to SEQ ID NO: 2262
  REGION 1..141: note = Description of Unknown: uncultivated organism
  REGION 1..141: note = MG4-29 RuvC-III domain

SEQ ID NO: 2273 - protein, 134 aa, unidentified
  REGION 1..134: note = Description of Unknown: uncultivated organism with predicted taxonomy: Alphaproteobacteria bacterium
  REGION 1..134: note = MG4-30 RuvC-III domain
NDTAYASRLAADYLGILYGGRTDREHRLRVQATAGQATARLRARWNLDSILDDGPTKHGGRASKERTDHRHHAIDAVVIGVTDQGMMERLSDAAKRGQEVGKRFARLDEPWNGFLEQVRKEVGQIVVSHRVSKK

SEQ ID NO: 2274 - protein, 131 aa, unidentified
  REGION 1..131: note = Description of Unknown: uncultivated organism
  REGION 1..131: note = MG4-31 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQAKVAVDKIVVSYRPDRK

SEQ ID NO: 2275 - protein, 133 aa, unidentified
  REGION 1..133: note = Description of Unknown: uncultivated organism
  REGION 1..133: note = MG4-32 RuvC-III domain
QETRYIGRLACDYLGLLYGGQVEAQGTAVSERRILTPTGGLVAWLRRGWGLNSVLSDRDEKERNDHRHHAVDAIVIACADQRAIQRLSESAERMEREGRERPYESVDPPWEGFEQSVQEAIHAVVVSHRQSRK

SEQ ID NO: 2276 - protein, 115 aa, unidentified
  REGION 1..115: note = Description of Unknown: uncultivated organism with predicted taxonomy: Insolitispirillum peregrinum
  REGION 1..115: note = MG4-33 RuvC-III domain
NDTRYLARESANYLGCLFTAEETEGPNPLRVFVVTGGLTNMMRGLWGLNTLAGGPANEKDRIDHRHHAIDALVVALTKQAHTQKLMSAAARAERQHLLRNFQDVAHPWADFAEQA

SEQ ID NO: 2277 - protein, 129 aa, unidentified
  REGION 1..129: note = Description of Unknown: uncultivated organism with predicted taxonomy: Planctomycetes bacterium
  REGION 1..129: note = MG4-34 RuvC-III domain
NDTRYMSRVACEYLGALYGGLSDEYHRRRVQSTTGGLTFELRRGWSLNSILGIGDEKNRADHRHHAVDAIVVALTGPKAIQQASRAAQRAETRGGARLFEEFEDPWPGFRDDVKAIVKSIVVSHRQSRK

SEQ ID NO: 2278 - protein, 133 aa, unidentified; identical to SEQ ID NO: 2275
  REGION 1..133: note = Description of Unknown: uncultivated organism
  REGION 1..133: note = MG4-35 RuvC-III domain

SEQ ID NO: 2279 - protein, 143 aa, unidentified
  REGION 1..143: note = Description of Unknown: uncultivated organism with predicted taxonomy: Proteobacteria
  REGION 1..143: note = MG4-36 RuvC-III domain
NDTRAASVAAARYLALLYGGEIVDGKRKILKITGQVTAYLRDVWGLNGLIPSIHREARGEAADAEAESRTLKSRDDHRHHAVDAVVVALCNQRWIQRLSEANRGALAARRRWFAPVEPPWVGFKEQLKDTLKSMNISFRPDHR

SEQ ID NO: 2280 - protein, 76 aa, unidentified
  REGION 1..76: note = Description of Unknown: uncultivated organism with predicted taxonomy: Solemya velesiana gill symbiont
  REGION 1..76: note = MG4-37 RuvC-III domain
NDTRASAVAAARYLSLLYGGETVDGKRKILKVTGQVTAYLRDVWGLNGLIPSIHREARGEAEDGQAEARPVKSRDD

SEQ ID NO: 2281 - protein, 127 aa, unidentified
  REGION 1..127: note = Description of Unknown: uncultivated organism with predicted taxonomy: Acidobacteria
  REGION 1..127: note = MG4-38 RuvC-III domain
NDTRYAAVVAGRYLSLLYGGEVIDGKRKILKVTGQITAHLRRVWGMNEILGRAGVKSRDDHRQHAIDAALVAVADQRSVQRLSQAAARAELQHRRRLPALEPPFVGFKEGLQCLVQTMNISFRPDHR

SEQ ID NO: 2282 - protein, 89 aa, unidentified
  REGION 1..89: note = Description of Unknown: uncultivated organism with predicted taxonomy: Planctomycetes
  REGION 1..89: note = MG4-39 RuvC-III domain
NDTRYSSRLASEYLSLLYGGRSDAQGNLRVQASTGAVTSLLRDQWGLNAILAELGRQLGVSGLDDDVEKARFDHRHHAVDALVIALTTP

SEQ ID NO: 2283 - protein, 127 aa, unidentified
  REGION 1..127: note = Description of Unknown: uncultivated organism with predicted taxonomy: Thermogutta terrifontis
  REGION 1..127: note = MG4-40 RuvC-III domain
SDTRWISRTAADYLGLLYGGRIDPTGKQRIQTTAGRLTALLRRAWDLDSILGPGTEKNRADHRQHAIDAVVIALTDPAVVHRLSRWASHRPSWVRITPQLDSPWPGFFDQVKHRILSILVSFRQHRR

SEQ ID NO: 2284 - protein, 116 aa, unidentified
  REGION 1..116: note = Description of Unknown: uncultivated organism with predicted taxonomy: Planctomycetes
  REGION 1..116: note = MG4-41 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPP

SEQ ID NO: 2285 - protein, 127 aa, unidentified; identical to SEQ ID NO: 2283
  REGION 1..127: note = Description of Unknown: uncultivated organism with predicted taxonomy: Thermogutta terrifontis
  REGION 1..127: note = MG4-42 RuvC-III domain

SEQ ID NO: 2286 - protein, 127 aa, unidentified; identical to SEQ ID NO: 2283
  REGION 1..127: note = Description of Unknown: uncultivated organism
  REGION 1..127: note = MG4-43 RuvC-III domain

SEQ ID NO: 2287 - protein, 132 aa, unidentified
  REGION 1..132: note = Description of Unknown: uncultivated organism with predicted taxonomy: Proteobacteria
  REGION 1..132: note = MG4-44 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAAQQLACQRSIRGYQKFMEDPWPHFLEDVRKAVNAIVVSHRVDHR

SEQ ID NO: 2288 - protein, 132 aa, unidentified; identical to SEQ ID NO: 2287
  REGION 1..132: note = Description of Unknown: uncultivated organism
  REGION 1..132: note = MG4-45 RuvC-III domain

SEQ ID NO: 2289 - protein, 127 aa, unidentified; identical to SEQ ID NO: 2283
  REGION 1..127: note = Description of Unknown: uncultivated organism
  REGION 1..127: note = MG4-46 RuvC-III domain

SEQ ID NO: 2290 - protein, 143 aa, unidentified
  REGION 1..143: note = Description of Unknown: uncultivated organism with predicted taxonomy: Proteobacteria
  REGION 1..143: note = MG4-47 RuvC-III domain
NDTRASAVAAARYLSLLYGGETVDGKRKILKVTGQVTAYLRDVWGLNGLIPSIHREARGEAEDRQAEARPVKSRDDHRHHAVDAVVVALCNQGWIQRLSEANRGALAARRRLFAPVEPPWVGFKEQLKDILKSMNISFRPDHR

SEQ ID NO: 2291 - protein, 122 aa, unidentified
  REGION 1..122: note = Description of Unknown: uncultivated organism
  REGION 1..122: note = MG4-48 RuvC-III domain
HATAYAARVAARELARLYPNQERAHRIWVSSGRATACLRDAWQLNQLLGRKDEKNRADHRHHMVDAVVVALTTPKIVQDLTHAAQNAVRARRFQGMEPPSGLHEALRQRLEKVIVSHRVERK

SEQ ID NO: 2292 - protein, 143 aa, unidentified
  REGION 1..143: note = Description of Unknown: uncultivated organism
  REGION 1..143: note = MG4-49 RuvC-III domain
NDTRYSSRLAAEYLSLLYGGRYDAQGNLRVQASTGTVTAQLRGQWGLNAILAELGRQLGVRDLDNDVEKARFDHRHHAVDALVIALTTPAMIKRFSDESQRARQYGRQFRCFFDPPWGTRAQFVADVRNAVLAINVSRRVDRR

SEQ ID NO: 2293 - protein, 92 aa, unidentified
  REGION 1..92: note = Description of Unknown: uncultivated organism with predicted taxonomy: Solemya velesiana gill symbiont
  REGION 1..92: note = MG4-51 RuvC-III domain
NDTRAAAVAAARYLALLFGGETVGGKLKILKITGQVTAHLRDAWDLNGLIPSIHRETRGEAADKEPKTPPLKSRDDHRHHAVDAVVVALCDQ

SEQ ID NO: 2294 - protein, 143 aa, unidentified
  REGION 1..143: note = Description of Unknown: uncultivated organism
  REGION 1..143: note = MG4-52 RuvC-III domain
NDTRASAVAAARYLSLLYGGETVDGKRKILKVTGQVTAYLRDVWGLNGLIPSIHREARGEAEDGQAEARPVKSRDDHRHHAVDAVVVALCNQGWIQRLSEANRGALAARRRLFAPVEPPWVGFKEQLKDILKSMNISFRPDHR

SEQ ID NO: 2295 - protein, 128 aa, unidentified
  REGION 1..128: note = Description of Unknown: uncultivated organism
  REGION 1..128: note = MG4-53 RuvC-III domain
NDTRYAARAAAEYLGRLYGGQSDAGHRRRIQVATGQVTAFLRREWGLNAILGDGDEKSRDDHRHHAVDALCVALTDAGIVQALAAAAARAPAEGRRCFARLAPPWPSFLADARRAVLEITVSHRVRRK

SEQ ID NO: 2296 - protein, 127 aa, unidentified; identical to SEQ ID NO: 2281
  REGION 1..127: note = Description of Unknown: uncultivated organism
  REGION 1..127: note = MG4-54 RuvC-III domain

SEQ ID NO: 2297 - protein, 132 aa, unidentified
  REGION 1..132: note = Description of Unknown: uncultivated organism with predicted taxonomy: Flavobacterium hercynium
  REGION 1..132: note = MG4-55 RuvC-III domain
NDTRHAAKVAMGYLGLLYPKEERLKRVKAFAGGVTGELRKCWKLNSILGDPDSVEPKKNRADHRHHAIDALVLALATPGMVQYLSKAAEQQLACQRSIRGYQKFMEDPWPHFLEDVRKAVNAIVVSHRVDHR

SEQ ID NO: 2298 - protein, 143 aa, unidentified; identical to SEQ ID NO: 2279
  REGION 1..143: note = Description of Unknown: uncultivated organism with predicted taxonomy: Pseudoxanthobacter soli
  REGION 1..143: note = MG4-56 RuvC-III domain

SEQ ID NO: 2299 - protein, 128 aa, unidentified
  REGION 1..128: note = Description of Unknown: uncultivated organism with predicted taxonomy: candidate division Zixibacteria bacterium CG_4_9_14_3_um_filter_46_8
  REGION 1..128: note = MG4-57 RuvC-III domain
NDTRYASVLAAKYLGALYGGAIDAEHTRRIQVSAGMVTAYLRNEYGLNPILGDGGEKSRDDHRHHAIDAICVALTDAATVKMLSDAASRALSERRRQFGHIDPPWPSFLADVRKHIDDLIVSHAVSRK

SEQ ID NO: 2300 - protein, 143 aa, unidentified; identical to SEQ ID NO: 2294
  REGION 1..143: note = Description of Unknown: uncultivated organism
  REGION 1..143: note = MG4-58 RuvC-III domain

SEQ ID NO: 2301 - protein, 143 aa, unidentified; identical to SEQ ID NO: 2294
  REGION 1..143: note = Description of Unknown: uncultivated organism with predicted taxonomy: Proteobacteria
  REGION 1..143: note = MG4-60 RuvC-III domain

SEQ ID NO: 2302 - protein, 127 aa, unidentified; identical to SEQ ID NO: 2283
  REGION 1..127: note = Description of Unknown: uncultivated organism with predicted taxonomy: Thermogutta terrifontis
  REGION 1..127: note = MG4-61 RuvC-III domain

SEQ ID NO: 2303 - protein, 124 aa, unidentified
  REGION 1..124: note = Description of Unknown: uncultivated organism
  REGION 1..124: note = MG4-62 RuvC-III domain
QDTRYITTLARDFVSLLYGKDASAIVTPSGPLTAWLRRGWHLNSVLGFTDEKEREDHRHHAVDAIVIALATRSNIKRLSDAAERVEREGREKAFGTVDPPWDGFEHEVRSIIDGVVVSHRQSQR

SEQ ID NO: 2304 - protein, 132 aa, unidentified
  REGION 1..132: note = Description of Unknown: uncultivated organism with predicted taxonomy: Planctomyces sp. SH-PL14
  REGION 1..132: note = MG4-63 RuvC-III domain
SETRYIARQAADYLGLLYGGRIEQRAGDEVGRRRVLVTPGRATALLRNGWQLASVTGGLKNRQDHRHHAIDALIVGLTQDGFLKQLSEAAARADELQLTRLTTEMDSPWETFLDDVGKGYERIHVSTRPTRK

SEQ ID NO: 2305 - protein, 124 aa, unidentified; identical to SEQ ID NO: 2303
  REGION 1..124: note = Description of Unknown: uncultivated organism
  REGION 1..124: note = MG4-64 RuvC-III domain

SEQ ID NO: 2306 - protein, 128 aa, unidentified
  REGION 1..128: note = Description of Unknown: uncultivated organism
  REGION 1..128: note = MG4-65 RuvC-III domain
QDTRYACRLAADYLGRLYGGRVDAQGKMRIEVRPGGLTAHVRNELMLHAILDDGGAKTRADHRHHAVDALAVGLTSQSMVQQLQTAAGRALQAGRRLFAPVPEPWTGFLEDARRSIGQIIVSRRPDRK

SEQ ID NO: 2307 - protein, 143 aa, unidentified
  REGION 1..143: note = Description of Unknown: uncultivated organism
  REGION 1..143: note = MG4-66 RuvC-III domain
NDTRYSSRLAAEYLALLYGGRSDAQGNLRVRAITGAVTAQLRDQWGLNAVLAELGRQLGVRDLDDNVEKARFDHRHHAVDALVIALTTPGMVKRFSDESQRARQYGRQLRCFFDPPWGTRTEFVADVRNAVLAINVSRRLDRR

SEQ ID NO: 2308 - protein, 128 aa, unidentified
  REGION 1..128: note = Description of Unknown: uncultivated organism with predicted taxonomy: Proteobacteria
  REGION 1..128: note = MG4-67 RuvC-III domain
NDTRYASRLAAEYVGLLYGGRADAEHRQRVYVCTGGTTAFLRNEWKLNTILGDGGPKTRDDHRHHAVDALVIALTGPATVKMLADAADNPWQHRRRLFAPIQEPWVGFLDQAREAILRINVSHRVNRR

(The sequence listing continues in the following parts.)

What is claimed is:

1. A method of modifying a target nucleic acid in an isolated cell, said method comprising introducing to said cell:

(a) an endonuclease or a nucleic acid encoding said endonuclease, wherein said endonuclease comprises a RuvC_III domain and an HNH domain, wherein said endonuclease comprises an amino acid sequence having at least 90% sequence identity to SEQ ID NO: 421; and (b) an engineered guide ribonucleic acid structure or a nucleic acid encoding said engineered ribonucleic acid structure, wherein said engineered guide ribonucleic acid structure comprises:

i) a guide ribonucleic acid sequence configured to hybridize to a portion of said target nucleic acid; and ii) a tracr ribonucleic acid sequence configured to form a complex with said endonuclease.

2. The method of claim 1, wherein said endonuclease comprises an amino acid sequence having at least 95% sequence identity to SEQ ID NO: 421.

3. The method of claim 2, wherein said endonuclease comprises the amino acid sequence of SEQ ID NO: 421.

4. The method of claim 1, wherein said RuvC_III domain comprises a sequence having at least 90% sequence identity to SEQ ID NO: 2242.

5. The method of claim 4, wherein said RuvC_III domain comprises the sequence of SEQ ID NO: 2242.

6. The method of claim 1, wherein said HNH domain comprises a sequence having at least 90% sequence identity to SEQ ID NO: 4056.

7. The method of claim 6, wherein said HNH domain comprises the sequence of SEQ ID NO: 4056.

8. The method of claim 1, wherein said endonuclease is configured to bind to a protospacer adjacent motif (PAM) sequence of SEQ ID NO: 5517.

9. The method of claim 1, wherein said endonuclease is a class 2, type II Cas endonuclease.

10. The method of claim 1, wherein said tracr ribonucleic acid sequence comprises a sequence having at least 80% sequence identity to about 60 to 90 consecutive nucleotides of SEQ ID NO: 5495.

11. The method of claim 1, wherein said endonuclease and said tracr ribonucleic acid sequence are derived from distinct bacterial species within a same phylum.

12. The method of claim 1, wherein said engineered guide ribonucleic acid structure comprises at least two ribonucleic acid polynucleotides.

13. The method of claim 1, wherein said engineered guide ribonucleic acid structure comprises one ribonucleic acid polynucleotide comprising said guide ribonucleic acid sequence and said tracr ribonucleic acid sequence.

14. The method of claim 1, wherein said guide ribonucleic acid sequence is complementary to a eukaryotic, mammalian, or human genomic sequence.

15. The method of claim 1, wherein said endonuclease comprises one or more nuclear localization sequences (NLSs) proximal to an N- or C-terminus of said endonuclease.

16. The method of claim 15, wherein said one or more NLSs comprises a sequence selected from any one of SEQ ID NOs: 5597-5612.

17. The method of claim 1, further comprising introducing into said cell a single-stranded or double-stranded deoxyribonucleic repair template comprising from 5' to 3': a first homology arm comprising a sequence 5' to said target nucleic acid sequence, a synthetic deoxyribonucleic acid sequence, and a second homology arm comprising a sequence 3' to said target nucleic acid sequence.

18. The method of claim 1, wherein said modifying comprises binding, nicking, cleaving, or marking said target nucleic acid.

19. The method of claim 18, wherein said target nucleic acid comprises genomic deoxyribonucleic acid (DNA).

20. The method of claim 1, wherein said cell is a eukaryotic cell, an animal cell, a mammalian cell, a primate cell, or a human cell.

\* \* \* \* \*